United States Patent 8,344,211 (PLANT NUCLEOTIDE SEQUENCES AND CORRESPONDING POLYPEPTIDES) - sequence listing, part 10

SEQ ID NO: 37445 - protein, 173 aa, Zea mays
  misc_feature: Ceres CLONE 1423239-F
  misc_feature: SWISSPROT Homolog: EC 1.5.3.1 Sarcosine oxidase
MAGAGAPAVPQAGRPAPNFDVIVVGAGIMGSCTAHAAASRGARVLLLERFDLLHPLGSSHGDSRIIRDAYAQPRYLRMVRLARRLWAAAEAEAGYRVLTPTPHLSMGRRSSASLAGGIANIGAEGVDEDDLSPQVGRRPSPHRPGPRLNAWVTALSDHGRRAQRPPKPVAMFQ

SEQ ID NO: 37446 - DNA, 643 bp, Zea mays
  misc_feature: Ceres CLONE 1423242-F
  misc_feature: Encodes the peptide sequence at SEQ ID NO. 37447
  misc_feature (643)..(643): n is a, c, t, g, unknown, or other
aaaagctggagctccccgcggtggcggccgctctagaactagtggatcccccgggctgcaggaattcgcacgagaccattacctagaacatcctaatcgaaaagcactcgcactcgcactcgcacctgcacctcgcactagctagtcttgccaattaagctaggtatagaccagcatggcttctgctctcaagatgacggccatctgcatgctgatcctgaccacgggccagctgatggcaactgccggtgcaaaggcgccgctggtgcaggcggacgccgcgcctacggctcgccgtctgctctcggcggaccatgagcgctcagcctccgggaggacgagcaactgcccctgcaccgccatgactccgtggtgttgcttcggtttgcagaggacggcgacggagaactgcccctgcaccgccaggactccgtggtgttgctccggtttgcagaagacggcgctagaggactgcccctgcagcccatttacaccatggtgctgctccggtttgcagaagacggcgctggagaactgcccctgcacccccatgactccattctgttgctttggcgccggcagtgctgtcacaaactggaatcttcatgagaaaaacatgcatgcagatggatgtggcctctan

SEQ ID NO: 37447 - protein, 155 aa, Zea mays
  misc_feature: Ceres CLONE 1423242-F
MASALKMTAICMLILTTGQLMATAGAKAPLVQADAAPTARRLLSADHERSASGRTSNCPCTAMTPWCCFGLQRTATENCPCTARTPWCCSGLQKTALEDCPCSPFTPWCCSGLQKTALENCPCTPMTPFCCFGAGSAVTNWNLHEKNMHADGCGL

SEQ ID NO: 37448 - DNA, 704 bp, Zea mays
  misc_feature: Ceres CLONE 1423254-F
  misc_feature: Encodes the peptide sequence at SEQ ID NO. 37449
  misc_feature (704)..(704): n is a, c, t, g, unknown, or other
ctccccgcggtggcggccgctctagaactagtggatcccccgggctgcaggaattcgcacgagaccattacctagaacatcctaatcgaaaaagttactaagttaaccctcgctcttcctttcccctcggttctcgttgtctgacaggcaaagcggctatgacgacaacggccgccgggtacggctgctgctgggcggggattccgcccttcgcgttgttgccgcggattctctcgacccgccgggagactcctcctcctcctcctcctcgcgcttcccttgtcgcctcctcctcgaagctcagggcgctggcaccacggctgagagtttcgaaccgtccaaggaggctcattgtctccgcttcctcctccggcgaggccaattcggacgcggcgccgtcgccaacggtctttcgttgcttgtgtgtcttgcagattatggcattcagagaacatcactttttgtaaatttggcaggttgatcgcatacatatgtgagcatatgaaaaagaaatgatattatataattcagcggtttattgcatgaaagacaacataacagattgcttgctgattgaggaacaaactaggttcagaaatgaataacaagtgctcaactttgctggtagattgattactgaaagcgcaaactgcacactagtttataggccggaatctccttatgtacatgttattcgtgtgatn

SEQ ID NO: 37449 - protein, 102 aa, Zea mays
  misc_feature: Ceres CLONE 1423254-F
MTTTAAGYGCCWAGIPPFALLPRILSTRRETPPPPPPRASLVASSSKLRALAPRLRVSNRPRRLIVSASSSGEANSDAAPSPTVFRCLCVLQIMAFREHHFL

SEQ ID NO: 37450 - DNA, 640 bp, Zea mays
  misc_feature: Ceres CLONE 1423256-F
  misc_feature: Translation starting site: 155
  misc_feature (220)..(220): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (352)..(352): n is a, c, t, g, unknown, or other
  misc_feature (359)..(359): n is a, c, t, g, unknown, or other
  misc_feature (370)..(370): n is a, c, t, g, unknown, or other
  misc_feature (372)..(372): n is a, c, t, g, unknown, or other
  misc_feature (373)..(373): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcctccttatgctccttggtctttctgcaagtgctgctacggcgaanccattnnnttcccgcaatgctcgcaagctcctatagcttcccttcttcccccgtacctctcaccagcggtgtcttcggtatgtgaaaacccaattcttcaaccctacaggatccaacaggcaatcgcagctnggcatcnttaccctttantnncaccccttgttcccctccaacaatcatcagccctattacaacagttacctttggtgcattttattggcacaaaacatcangggcacaacaactacaacaacttgtgctagcaaaacttgctgcctactctcagcaacagcagtttcttcccatcaaacaactagggtcattgaactctgctttctatttgcaacaacaacaactacccattcagccaggtttccttgctggctaccccccagaatttcttccccttcaaccaactat

SEQ ID NO: 37451 - DNA, 724 bp, Zea mays
  misc_feature: Ceres CLONE 1423259-F
ctccccgcggtggcggccgctctagaactagtggatcccccgggctgcaggaattcgcacgagaccattacctagaacatcctaatcgaaaaaatcagaaatcgacgagtgatgtacgtaactgatccagccaccccggtcgagtgccacccactccacggcgccgaatcgcagataatgtagagtgcgccgcgccgtgacggcgtggatgagaaagcctccaaacctctctgtttcgggctctccgtccccggcgtccaacacccatactctccccaggttggtgtgccacacccacactcaactatatacgaaaaccgccggcgcctggcccctaggccctagtcacagaccccttgttctttccttcaacgcgccccccccgggatgggcaaacccccgtgtttgcccatggggtttggccctcgcgtttcgtggcctttaccgcctctttgtttgccgcccgggggccctccgaatttacccccggttggacacccccgggccgggatccaagggattccctaaactgttcctcccctccgggaattgggggacccaagggggaatcccaaaccccgccccggggtgcccccaccaaaaatggaaaagggctcggggaaaaaaccccaaaatcccccttttttttaattcccccgcgggggatacatttttccaaaaaaacacgccctctaggagggggtgcggcccaccagctgttttt

SEQ ID NO: 37452 - DNA, 693 bp, Zea mays
  misc_feature: Ceres CLONE 1423269-F
  misc_feature: Encodes the peptide sequence at SEQ ID NO. 37453
tccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtggggcttcttctggctggtgaaccacggagtgccggaggagctgatgggcggcatgctcccgcggggtgcgccagttcaacgagggcccccgtggaagcgaaagcaggcgcctctactccgagggacctccgctccgcaacctggccctttcgccctccaaccttcgacccccttcaaagggctgctgcgcgcccaactgggcggcaacaacgcctccttcctgccgagggggggctccccaaacccccgcccgccccgcggggagagga

SEQ ID NO: 37453 - protein, 185 aa, Zea mays
  misc_feature: Ceres CLONE 1423269-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGLLLAGEPRSAGGADGRHAPAGCASSTRAPVEAKAGASTPRDLRSATWPFRPPTFDPLQRAAARPTGRQQRLLPAEGGLPKPPPAPRGE

SEQ ID NO: 37454 - DNA, 668 bp, Zea mays
  misc_feature: Ceres CLONE 1423270-F
  misc_feature: Encodes the peptide sequence at SEQ ID NO. 37455
  misc_feature (507)..(507): n is a, c, t, g, unknown, or other
  misc_feature (524)..(524): n is a, c, t, g, unknown, or other
  misc_feature (525)..(525): n is a, c, t, g, unknown, or other
  misc_feature (528)..(528): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtngttcgccatccctgccnngcntggttgggccccgcttccaaactagcggggcttggaccaagttgggcggcctggggccacaaaaaaccttggaacccaaaaccccggggggggcctatatcccggggggggaaaaaaagggggctccccctcttggtggg

SEQ ID NO: 37455 - protein, 108 aa, Zea mays
  misc_feature: Ceres CLONE 1423270-F
  misc_feature (14)..(100): Pfam Name: AWPM-19 Pfam Description: AWPM-19-like family
  misc_feature (61)..(61): Xaa is any aa, unknown, or other
MAGIGRNMVAPLLVLNLIMYIIVIGFASWNLNHFINGQTNYPGVAGNGATFYFLVVRHPCXAWLGPASKLAGLGPSWAAWGHKKPWNPKPRGGPISRGGKKRGLPLLV

SEQ ID NO: 37456 - DNA, 604 bp, Zea mays
  misc_feature: Ceres CLONE 1423305-F
  misc_feature (223)..(223): n is a, c, t, g, unknown, or other
  misc_feature (238)..(238): n is a, c, t, g, unknown, or other
aagctggagctccaccgcggtggcggccgctctagaactagtggatcccccgggctgcaggaattcgcacgagaccattacctagaacatcctaatcgaaaaatccccctgtgctctcctctcgtggccttgtttcctggcggcgacggctggtcgagcggcgccgcccttggctaggtcttcgctgggtccttccccggcgacgagcgtccatctggggtcngactgaactgagcanggcagtaaggaaggagacactatgttgttcttctccctactcaagagctgtggggaaggagtgacagtggactcaagatgactggcgatccgcggaccctccatccggtgaccagtaccttcacctcaagctccgaaaccccccgtatccaccgggaaaatttcccccatgttttagggggaattgttttctaagggcccgggggggggaaatggttttcccccaggaagggggggaattaaattcccccaaaaccccccccaaggggggccccccgaatgttttttttgttgtcccccccccccccccccccgggggggggggtggtgtttctcccccccttttgttgtaaaaaaatgtgttttt

SEQ ID NO: 37457 - DNA, 819 bp, Zea mays
  misc_feature: Ceres CLONE 1423312-F
  misc_feature: Encodes the peptide sequence at SEQ ID NO. 37458
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (614)..(614): n is a, c, t, g, unknown, or other
tcccccccccnnnnnngnnnnnnccgccgggggggggtattgccnncnncnaaaaatgggactccccgcggtggcggccgctctagaactagtggatcccccgggctgcaggaagtcgcacgagaccattacctagaacatcctaatcgaaaaatggtcttcgccccctcgcgcttacggctgcagcgcctcaggactcgccgcctccgcctagctccgggctctccaatggcctccatgctcgccatcctcaggccctcggcgccggccccgctcgcgggacgccgggccagggctgccgcgcccggcgacccgcgagggtggcgctatctaccagatctaggtattcgtccggtcagggtgtcggtcggctcccaggttgcagtggggcccgacgcgttcttcgccgactataaacccaccaccgctttgtcttctcccccgggcccagggtggcccaggcccgtccggaatggggggcccaagaccttcggagctgttcccaggaagggtaccgaatttgtttgtccccggggcaaaaccgaaatacccctggggaacatcgaccggtgccccgggaaatttattggctcgggataacccgcccccccccnacccccccacccgtgccccttccgaccaaggcgcctccggttcccgcgcgcgccaatatacactgggcgccccaaacgcgcttgtcccgcgagtcctgagaggcggcgctttgatgggccccccgaaactggaggcgccagcggcggggggacgagaggcccgcgggaagaagagctcacctcgggggcggcgggagggtgcggg

SEQ ID NO: 37458 - protein, 148 aa, Zea mays
  misc_feature: Ceres CLONE 1423312-F
MVFAPSRLRLQRLRTRRLRLAPGSPMASMLAILRPSAPAPLAGRRARAAAPGDPRGWRYLPDLGIRPVRVSVGSQVAVGPDAFFADYKPTTALSSPPGPGWPRPVRNGGPKTFGAVPRKGTEFVCPRGKTEIPLGNIDRCPGKFIGSG

SEQ ID NO: 37459 - DNA, 719 bp, Zea mays
  misc_feature: Ceres CLONE 1423320-F
  misc_feature: Encodes the peptide sequence at SEQ ID NO. 37460
  misc_feature (476)..(476): n is a, c, t, g, unknown, or other
  misc_feature (477)..(477): n is a, c, t, g, unknown, or other
  misc_feature (532)..(532): n is a, c, t, g, unknown, or other
aagctggagctccccgcggtggcggccgctctagaactagtggatcccccgggctgcaggaattcgcacgagaccattacctagaacatcctaatcgaaaaaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaagcatgcagatctttgtgaaaaccctgaccgggcagactatcaccctcgaggtggagtcctctgacaccattnngacacgtcaggccaagatcccaggacaggagggcatccctccagaacagcagccnctcatctttgctgggaaacaccttgaggacgggcgcacccttgcccaactacaacttcaggaggaaaagcaccctccactgggggctgcgcctcaggggagggatgcaaattttcgtgaaaaccctgaccggaaaaattttcccccggagggggagtttttaaaacccctcgaaaagttagggcaaa

SEQ ID NO: 37460 - protein, 180 aa, Zea mays
  misc_feature: Ceres CLONE 1423320-F
  misc_feature (6)..(74): Pfam Name: ubiquitin Pfam Description: Ubiquitin family
  misc_feature (82)..(144): Pfam Name: ubiquitin Pfam Description: Ubiquitin family
  misc_feature (100)..(100): Xaa is any aa, unknown, or other
MQIFVKTLTGKTITLEVESSDTIDNVKAKIQDKEGIPPDQQRLIFAGKQLEDGRTLADYNIQKESTLHLVLRLRGSMQIFVKTLTGQTITLEVESSDTIXTRQAKIPGQEGIPPEQQPLIFAGKHLEDGRTLAQLQLQEEKHPPLGAAPQGRDANFRENPDRKNFPPEGEFLKPLEKLGQ

SEQ ID NO: 37461 - DNA, 639 bp, Zea mays
  misc_feature: Ceres CLONE 1423322-F
  misc_feature: Translation starting site: 307
  misc_feature (150)..(150): n is a, c, t, g, unknown, or other
  misc_feature (368)..(368): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
ctggagctccaccgcggtggcggccgctctagaactagtggatcccccgggctgcaggaattcgcacgagaccattacctagaacatcctaatcgaaaaaaaactcccagccgtctcctccgcatgcgaaaaccctagcagctccgcagntccctctcctctcgaggtggcggcgctccctcctgttttcctcttcttcttcctgtactatatagcctcccctcgcaaatcgtcactgacgagtgatgtcattccgcttgcttgattgttccagatattcgcagttgaccgggtcctcggagcacgatgaagtttgttgctgcctacttgcttgctgtcctcgctgggaacgccagcccctccgctgnaagattgactgccatttctgagtcagttggctgtgaaaagtgacatgaaaggatggaactcctgctgtcccannnctgacgtaggacatcaccgagctcatttgcccgggcagggagaagtttgctccaatcccatgtggtggcggtgggggccccttgttggggaaactttcactggctggttgggggacctgctcctaacgcttaaggcaaaaaaaaaaaaaaaaagggggaaaaaaaaaagggaaaaaaaccccttttattaatttgg

SEQ ID NO: 37462 - DNA, 722 bp, Zea mays
  misc_feature: Ceres CLONE 1423324-F
  misc_feature: Encodes the peptide sequence at SEQ ID NO. 37463
  misc_feature (567)..(567): n is a, c, t, g, unknown, or other
  misc_feature (650)..(650): n is a, c, t, g, unknown, or other
  misc_feature (651)..(651): n is a, c, t, g, unknown, or other
aagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacatacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggcccgccgcgccggcagcagagacggaagctgctgctgccccngtcgaggctgctgagccggagataccgccgaagaccaagaggtggcgctgtgaggggcttaacgagggagggagagggaggcnnccgcctgctgttgctgccactcctgaagtccacacgaccgaagaggaggcggcggccctgttccccaaggc

SEQ ID NO: 37463 - protein, 113 aa, Zea mays
  misc_feature: Ceres CLONE 1423324-F
  misc_feature (110)..(110): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEARRAGSRDGSCCCPXRGC

SEQ ID NO: 37464 - DNA, 630 bp, Zea mays
  misc_feature: Ceres CLONE 1423325-F
  misc_feature: Encodes the peptide sequence at SEQ ID NO. 37465
  misc_feature (515)..(515): n is a, c, t, g, unknown, or other
  misc_feature (518)..(518): n is a, c, t, g, unknown, or other
  misc_feature (595)..(595): n is a, c, t, g, unknown, or other
gctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggcccgggcaacggcgcgacgttctaccttcctggtgtcccccatcctgnccngggcttgtgggcccccgcttccaaacttggggggcgtggcaccccctggggggcccccgggggcccccaaaaaaaantggggccacaaagcccgggttttttttttccgggg

SEQ ID NO: 37465 - protein, 98 aa, Zea mays
  misc_feature: Ceres CLONE 1423325-F
  misc_feature (61)..(61): Xaa is any aa, unknown, or other
  misc_feature (62)..(62): Xaa is any aa, unknown, or other
  misc_feature (87)..(87): Xaa is any aa, unknown, or other
MAGIGRNMVAPLLVLNLIMYIIVIGFASWNLNHFINGQTNYPGVARATARRSTFLVSPILXXACGPPLPNLGGVAPPGGPPGAPKKXWGHKARVFFFR

SEQ ID NO: 37466 - DNA, 662 bp, Zea mays
  misc_feature: Ceres CLONE 1423331-F
  misc_feature: Encodes the peptide sequence at SEQ ID NO. 37467
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (591)..(591): n is a, c, t, g, unknown, or other
  misc_feature (592)..(592): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (621)..(621): n is a, c, t, g, unknown, or other
  misc_feature (628)..(628): n is a, c, t, g, unknown, or other
  misc_feature (629)..(629): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (638)..(638): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaactgggactccacgcggtggcggccgctctagaatagtggatcccccgggctgcaggaattcgcacgagaccattacctagaacatcctaatcgaaatcaccaccactgggtcttcagaccattagctttatctactccagagcgcagaacaaccgatcgacacatgaggggttgctcgttgcctcgctctcctgctctcgtgcgagcgcgactcacgcatacagctgcggctgcggatgacagcaccgccgctggtcatctaccgacgccgggggaatctgccacctccgattaactgccaacttccgggggattttccacccccgggtccaccgggcccccccccggttcccactgccaccccccggggtcaatttgcccccccccccccctttttttttttttttggcgcgcccccccccccccccgtgggggaaaaaacaccccccccccccctcctctnncccttcnnnncccggcgcggggggcgggnttgggtnnttnnncttnaaccccccctcnnncacccccccc

SEQ ID NO: 37467 - protein, 12 aa, Zea mays
  misc_feature: Ceres CLONE 1423331-F
KLGLHAVAAALE

SEQ ID NO: 37468 - DNA, 804 bp, Zea mays
  misc_feature: Ceres CLONE 1423332-R
  misc_feature (444)..(444): n is a, c, t, g, unknown, or other
  misc_feature (697)..(697): n is a, c, t, g, unknown, or other
gcccccctcgaggtcgacggtatcgataagcttttttttttttttttttcttttttttctttttttttttttttttttttttttttttttttttttttttttcattaaaaccaaaacttttttatgaccatgcatattttattggtcataccacacatgataatgtgggtcgtcttactgcatttttacatatttagatagagagagatggtatagaggagatttcccaaatatcatgaatcagtagtagggcggaatggcagcggaaaccccacaggggttggtgcggtagctgggcagctggtactggtaaagtccacccatggccggcatgttctgcgccatcatcatggccatggggttgagaccctgggctgccagcagctgctgctgctgctgcatcaaaactggctcgtacaggctgctgctggcggcagcggcacnctcaagctgcatcatcatctgcagctgctgcgcgacggactgcacgtccatcatcctcatctgctgctggcagcactgttgccggagcggctggaacatggcgctcggctgccccacccggggtagtaaggcgccgcccccagcgggctgcactgcggctgcctcaggtactccccgtaggggtacagcccgccggcgccattattgtcgttaagccggggcccagccccttaaagccctgtaaacccccccnaaggggcaggggatttttcatttgaaaaaggcccttggcagctgaaaaaaacccgggccccccaacgaaaaacgaagaaccttccttcaaggcggtttctgggtcca

SEQ ID NO: 37469 - DNA, 567 bp, Zea mays
  misc_feature: Ceres CLONE 1423334-F
  misc_feature: Encodes the peptide sequence at SEQ ID NO. 37470
  misc_feature (349)..(349): n is a, c, t, g, unknown, or other
  misc_feature (363)..(363): n is a, c, t, g, unknown, or other
  misc_feature (384)..(384): n is a, c, t, g, unknown, or other
aagctggagctccccgcggtggcggccgctctagaactagtggatcccccgggctgcaggaattcgcacgagccattacctagaacatcctaatcgaaaagttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaaatcgccgtttccccgtgcgatttcagagtcagagtcatcgatgcaaaaaacgagttgaatccngagaaagtgagggnagatctgctccaatgatggcnggagaagcaatcaatccgtgggaaaaaccggagtcctcaaaaaatccctggggaattccttgaaacggcccaaccgggggtttaacccatccaagccgaacaaagacccaaatcggaaattttatccccccgttctgggtgcaaaaaacctttaaccagttcccccgggaggtttcttttcct

SEQ ID NO: 37470 - protein, 77 aa, Zea mays
  misc_feature: Ceres CLONE 1423334-F
  misc_feature (73)..(73): Xaa is any aa, unknown, or other
MATVQFFNQFPCTTRVQSPPNPKPLSKPTTLVPMSTLTRRPLFSPGEIAVSPCDFRVRVIDAKNELNPEKVRXDLLQ

SEQ ID NO: 37471 - DNA, 590 bp, Zea mays
  misc_feature: Ceres CLONE 1423355-F
  misc_feature (318)..(318): n is a, c, t, g, unknown, or other
  misc_feature (328)..(328): n is a, c, t, g, unknown, or other
  misc_feature (375)..(375): n is a, c, t, g, unknown, or other
  misc_feature (379)..(379): n is a, c, t, g, unknown, or other
  misc_feature (380)..(380): n is a, c, t, g, unknown, or other
  misc_feature (418)..(418): n is a, c, t, g, unknown, or other
  misc_feature (423)..(423): n is a, c, t, g, unknown, or other
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaaccccattcttncaccctacangatccaacaggcaatcgcagctggcatcttacctttatcacccttgntccnntcaacatcatcagccctatttacacagttacccttggntgcanttattggcacaaaacatcagggcacaacaactacaaacacttgttgctagcaaaccttgctggctactctcagcaaaaggaagtttctttcaattcaaccacctagggtcattggaactctggctccctaatttgaaaaaacaacactaacaatttagccaggttac

SEQ ID NO: 37472 - DNA, 676 bp, Zea mays
  misc_feature: Ceres CLONE 1423358-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (162)..(162): n is a, c, t, g, unknown, or other
  misc_feature (197)..(197): n is a, c, t, g, unknown, or other
  misc_feature (374)..(374): n is a, c, t, g, unknown, or other
  misc_feature (375)..(375): n is a, c, t, g, unknown, or other
  misc_feature (392)..(392): n is a, c, t, g, unknown, or other
  misc_feature (405)..(405): n is a, c, t, g, unknown, or other
  misc_feature (415)..(415): n is a, c, t, g, unknown, or other
  misc_feature (439)..(439): n is a, c, t, g, unknown, or other
  misc_feature (440)..(440): n is a, c, t, g, unknown, or other
  misc_feature (495)..(495): n is a, c, t, g, unknown, or other
  misc_feature (529)..(529): n is a, c, t, g, unknown, or other
  misc_feature (530)..(530): n is a, c, t, g, unknown, or other
nnnnnnnnnnnnnnnnnnnnnnnnnnnnnnnnnnnnnnnnnnnnnnnnnnnnnnnnnnnnnnaaggnnnnnnnnnnnnnnnnnnnnnnnnnnnnnnnnnnnnnnnnnnnnnnnnnnnnnnnnnnnnnnnnnnnnnnnnnnnnnccaaagctggactccccgncggtgggcggccgctctagaactagtggatccccncgggctgcaggaattcgcacgagaccattacctagaacatcctaatcgaaaaattccgtcgtcgtcgtcagcagcttctgcttgctctggggggaaggagagagagagagcgagagagagatctagtagagaggctagctaggtggtcctcgaacgaagatgttgggcggtgttcanncgggcaggttggtgaangtgccccgcgaancttggtggcnggcgggcagcccggacccccgtcnncccaagaaaccaaggcgttcccaagctgggtgggggcgcctttccttgggcccgnccttcccaaacccgggcccgggttccctggccannttttttgggggaaaacccgggggcaccctttcccttttatttcccccaaaccaaaaaaaaaggggggcgctcccctcccccccccccccaagggttttttttttcccgggggcacaaaaaaagaaaaaaaaaaaatatttttttct

SEQ ID NO: 37473 - DNA, 573 bp, Zea mays
  misc_feature: Ceres CLONE 1423360-F
  misc_feature: Encodes the peptide sequence at SEQ ID NO. 37474
  misc_feature (310)..(310): n is a, c, t, g, unknown, or other
  misc_feature (483)..(483): n is a, c, t, g, unknown, or other
  misc_feature (523)..(523): n is a, c, t, g, unknown, or other
  misc_feature (540)..(540): n is a, c, t, g, unknown, or other
aaagctggagctccccgcggtggcggccgctctagaactagtggatcccccgggctgcaggaattcgcacgagaccattacctagaacatcctaatcgaaaagatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcagggnggctagctagctgagctcgtgcgacgaagaaatgccggaattggcaagaaacatgtggcgccgctcctggtgctcaacctcatcatgtacatcatcgtcatcggcttcgcgagctggaacctgaaccacttcatcaacgggcagaccaactacccccggcgtggccggcaacngcgcgacgttctaacttcctgggtgtcgccatcctggccnggcctggtgggcccggncttccaagcttggcgggcgtgcacccagtgtcc

SEQ ID NO: 37474 - protein, 59 aa, Zea mays
  misc_feature: Ceres CLONE 1423360-F
  misc_feature (30)..(30): Xaa is any aa, unknown, or other
  misc_feature (49)..(49): Xaa is any aa, unknown, or other
MYIIVIGFASWNLNHFINGQTNYPRRGRQXRDVLTSWVSPSWPGLVGPXFQAWRACTQC

SEQ ID NO: 37475 - DNA, 628 bp, Zea mays
  misc_feature: Ceres CLONE 1423364-F
  misc_feature: Encodes the peptide sequence at SEQ ID NO. 37476
  misc_feature (423)..(423): n is a, c, t, g, unknown, or other
  misc_feature (429)..(429): n is a, c, t, g, unknown, or other
  misc_feature (430)..(430): n is a, c, t, g, unknown, or other
  misc_feature (494)..(494): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaacttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgataaacatcctcttccaaatcgtagtctagcccgtgcccaaaaccctagcgaccgccggagagctcgtccgaatcgaggccaccgaggggaaaatagatcgcggcggacgatggacagccctgctaaagagatgccgggggagagctggcaatggagatcgagtcgtcngtcacnngcgaagtactggcgcgcgcgctttctcgcgtcgtggcgtacgtcgtcgtccctcggacattggnagcgcgcgcatatgaaacgaagtcgcgggcgccagctacgccacgggtttcgtcgttgaacagtcccgcggcatatcctcactaaccgncatttcgtcaagcccagaacctgtgtctgcgaagccatgatcatg

SEQ ID NO: 37476 - protein, 57 aa, Zea mays
  misc_feature: Ceres CLONE 1423364-F
  misc_feature (9)..(9): Xaa is any aa, unknown, or other
  misc_feature (30)..(30): Xaa is any aa, unknown, or other
MEIESSVTXEVLARALSRVVAYVVVPRTLXARAYETKSRAPATPRVSSLNSPAAYPH

SEQ ID NO: 37477 - DNA, 674 bp, Zea mays
  misc_feature: Ceres CLONE 1423370-F
  misc_feature: Encodes the peptide sequence at SEQ ID NO. 37478
  misc_feature (395)..(395): n is a, c, t, g, unknown, or other
  misc_feature (473)..(473): n is a, c, t, g, unknown, or other
  misc_feature (536)..(536): n is a, c, t, g, unknown, or other
  misc_feature (537)..(537): n is a, c, t, g, unknown, or other
  misc_feature (565)..(565): n is a, c, t, g, unknown, or other
aagctggagctccccgcggtggcggccgctctagaactagtggatcccccgggctgcaggaattcgcacgagaccattacctagaacatcctaatcgaaaaaaaaggacactagtattggcccatcttcatcttcgtcgcagcgccggcgctccatctttcgctccatcccttactcgcgctcggcacaccggttctcagggcggcggcgctcaggctcgggctctcagcgacggcgtcaacggcttcccctcccgcctccgctcctccgcacaccggccggtgaccctgctcttatggcggcaagcgcgggcgagagccagggggtggaaagactcctctcctatgctgaagatctcgtggccgtcctttgcgtcagcaccgactgcgacgacnatgcacaggtcggtgccggagtgcagaagctgctgtctgcctgtcgatccgagtctgacgatctcgagatgcagctcnaagagtatcaggaaaaaatacactcctgcaaagaaaaagatgacaaagcaaaagctgaaaccnntactggacgatgaactccatgccctacnaagcaggatggaaagaaaacctgcccggaaaaaaacgcctcccccaaaagttaaaaatggtccctggaggagcttgatgaccccaaaaaggccaaaaccttttcttaaa

SEQ ID NO: 37478 - protein, 84 aa, Zea mays
  misc_feature: Ceres CLONE 1423370-F
  misc_feature (34)..(34): Xaa is any aa, unknown, or other
  misc_feature (60)..(60): Xaa is any aa, unknown, or other
  misc_feature (81)..(81): Xaa is any aa, unknown, or other
MAASAGESQGVERLLSYAEDLVAVLCVSTDCDDXAQVGAGVQKLLSACRSESDDLEMQLXEYQEKIHSCKEKDDKAKAETXTGR

SEQ ID NO: 37479 - DNA, 662 bp, Zea mays
  misc_feature: Ceres CLONE 1423372-F
  misc_feature: Encodes the peptide sequence at SEQ ID NO. 37480
aagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacattgaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggccacgcccacgctggccgccgtgcgggcgctcttccagctccgctcccaccgcgcgctgctggacgccaacggactcccgctctccacgccgcccacggcgcccgcgcccgtgccgctgcgggtccgcctgccctgcctctg

SEQ ID NO: 37480 - protein, 102 aa, Zea mays
  misc_feature: Ceres CLONE 1423372-F
MAPLPASLTPCLWLFLCLLAAPCPAARAARFACNATAPRASTCQALVSYAPPNGTATPTLAAVRALFQLRSHRALLDANGLPLSTPPTAPAPVPLRVRLPCL

SEQ ID NO: 37481 - DNA, 573 bp, Zea mays
  misc_feature: Ceres CLONE 1423376-F
  misc_feature: Encodes the peptide sequence at SEQ ID NO. 37482
  misc_feature (355)..(355): n is a, c, t, g, unknown, or other
  misc_feature (365)..(365): n is a, c, t, g, unknown, or other
  misc_feature (366)..(366): n is a, c, t, g, unknown, or other
  misc_feature (420)..(420): n is a, c, t, g, unknown, or other
agctccccgcggtggcggccgctctagaactagtggatcccccgggctgcaggaattcgcacgagaccattacctagaacatcctaatcgaaaaaaccgcatcatcctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctgggtgtggacctgacccaaccggtccactccacccggaaatcggcgcccacgccgactacngcgtcccttnncggcgctcacgggcactccacttcgtccagacgtcgtcctcagtccgacgccangtcgcctttccggctctgggatgagagctccgcttctggacctctcaacggctcacaccggcgcttcgtcggcacgagaagatgtctctccgtgcttcttccgtgacaccgcagattgtctcccgtccgggacagaacataactcttgacacc

SEQ ID NO: 37482 - protein, 120 aa, Zea mays
  misc_feature: Ceres CLONE 1423376-F
  misc_feature (68)..(68): Xaa is any aa, unknown, or other
  misc_feature (86)..(86): Xaa is any aa, unknown, or other
MAGAQESLSLVGTMRGHNGEVTAIATPIDNSPFIVSSSRDKSLLGVDLTQPVHSTRKSAPTPTTASLXGAHGHSTSSRRRPQSDAXSPFRLWDESSASGPLNGSHRRFVGTRRCLSVLLP

SEQ ID NO: 37483 - DNA, 691 bp, Zea mays
  misc_feature: Ceres CLONE 1423379-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (182)..(182): n is a, c, t, g, unknown, or other
  misc_feature (186)..(186): n is a, c, t, g, unknown, or other
  misc_feature (187)..(187): n is a, c, t, g, unknown, or other
  misc_feature (198)..(198): n is a, c, t, g, unknown, or other
  misc_feature (205)..(205): n is a, c, t, g, unknown, or other
  misc_feature (212)..(212): n is a, c, t, g, unknown, or other
  misc_feature (220)..(220): n is a, c, t, g, unknown, or other
  misc_feature (221)..(221): n is a, c, t, g, unknown, or other
  misc_feature (283)..(283): n is a, c, t, g, unknown, or other
  misc_feature (284)..(284): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaactgggggacctccaccgncggnntgggcggccgnctctagnaactagntggaatcnnccccgggctgcaggaattcgcacgagaccattacctagaacatcctaatcaaaaatactccnnctcagattcttaccaaaacacagggagcccgtcggccgtcgcaaaaaacaaaacaagaccaccgcaccatggaatcgctgacgcttcgcgcttcgacgggcgccctcgccgctgcagcgacgcccgctgctcccccggggcgcagcgcgcgaacgtacgtcccgcggccacggccttcgcccgggcaagccgggaacctcctccgggccccgctgaaccggggccttgcaaaattgccccaaaccccgtttctggaattccggggtcggggggccccaccggggggaccaaaatttacaccgtttattgaaaacccccccctttcaaaaaaaaggcctgtggggggccccctttttttccccaaaaaaagggggggccatttggggaggccgaaaaaaaattttttt

SEQ ID NO: 37484 - DNA, 651 bp, Zea mays
  misc_feature: Ceres CLONE 1423383-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (219)..(219): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttnnnnnnnnccaaactggaactccaccncggtggcggccgctctagaatagtggatcccccgggctgcaggaatcgcacgagaccattacctagaacatcctaatcgaaaacacgatcacacaccactccacagcagtagcaagagggatagagcaagggccacacacacacacacaccacttaggctagcctaagccttttagtcgttcggaggaaggagcaagaaaagggccccgccacgccaaagcccggggccaaaccaagaaaaaaaagcccgaatccgaaccgaaagaaccctaacccccgcccaaatgggccaaaggtccttcccaaaaaaagaatgggtgggggggaaaaacttctttgctgggccccttggggccccttggccccggggttcaaattcccccaaaaggcgaagggaaaactttcaaaagacccccccaacaaaaccgggaa

SEQ ID NO: 37485 - DNA, 802 bp, Zea mays
  misc_feature: Ceres CLONE 1423389-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (416)..(416): n is a, c, t, g, unknown, or other
  misc_feature (419)..(419): n is a, c, t, g, unknown, or other
  misc_feature (429)..(429): n is a, c, t, g, unknown, or other
  misc_feature (446)..(446): n is a, c, t, g, unknown, or other
  misc_feature (461)..(461): n is a, c, t, g, unknown, or other
  misc_feature (472)..(472): n is a, c, t, g, unknown, or other
  misc_feature (478)..(478): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggactccccgcggtggcggccgctctagactagtggatcccccgggctgcaggaattcgcacgagaccattacctagaacatcctaatcgaaaagcttcaatactagctcgctcaccactcaccagtcaccagtccagcaagcaacaacaaaggcgcaggaggaagctttgtttggaccgagcaagcgagccanccnaagcgtgganagagagagagagtattnatttgatggcgaagnaagcagctgcnacgccntcagcctgaacgaaggcggcaccaacgccaaacccggtgggcaggaaaacggccgcaagacggttggggttcccgccccccgggcccaaccccgggtgtgaagggaattcccgaagcacttccggttgtggccccattttccccaagaagggggtataggtttaaaaaaaaatccccaccgttttttgttgccccccaagggggtttaagggaaaccccccaaacccgttttttctaaagggggacccccggggaggggggatccacccccccccccccccgattttaaaaccacaggggttttctttttttctccccccccca

SEQ ID NO: 37486 - DNA, 622 bp, Zea mays
  misc_feature: Ceres CLONE 1423394-F
  misc_feature: Encodes the peptide sequence at SEQ ID NO. 37487
  misc_feature (52)..(52): n is a, c, t, g, unknown, or other
  misc_feature (398)..(398): n is a, c, t, g, unknown, or other
  misc_feature (449)..(449): n is a, c, t, g, unknown, or other
  misc_feature (622)..(622): n is a, c, t, g, unknown, or other
aaagctggagctccccgcggtggcggccgctctagaactagtggatcccccngggctgcaggaattcgcacgagaccattacctagaacatcctaatcgaaaaaagtccggagcaagagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgccgccctctccgtcgtctcattcccgcacctgtccctcctcgcctcgtcccatccgctcccgcaggaagctgctgctgctgctgcgggtgcggcggcgggaggcgaggcgtccaancctcacggcaccgccgccgatggtgccgccgtgggcgcgcgcgcgtgcacntacacggtgcagatcaagacgagctgcgcgtccccgcggagctccgcggacgcggtgagccctcgcgtcgggggacgcgtaccgcaacgaggtgtacgcggcgacggtgacgccgcggcgccgggttcaaacgctgcgccacggacaacgttcggcgtccgcgggccctgcgn

SEQ ID NO: 37487 - protein, 130 aa, Zea mays
  misc_feature: Ceres CLONE 1423394-F
  misc_feature (56)..(56): Xaa is any aa, unknown, or other
MASGAVPPQRVALLALAAALSVVSFPHLSLLASSHPLPQEAAAAAAGAAAGGEASXPHGTAADGAAVGARACTYTVQIKTSCASPRSSADAVSPRVGGRVPQRGVRGDGDAAAPGSNAAPRTTFGVRGPC

SEQ ID NO: 37488 - DNA, 591 bp, Zea mays
  misc_feature: Ceres CLONE 1423405-F
  misc_feature (263)..(263): n is a, c, t, g, unknown, or other
  misc_feature (399)..(399): n is a, c, t, g, unknown, or other
caaagctggagctccccgcggtggcggccgctctagaactagtggatcccccgggctgcaggaattcgcacgagaccattacctagaacatcctaatcgaaaatccctcccctccagcgctccagctcccctccatcctcggccaaaaattctgcggcgagctccgatccggtccgactactaacccacgccgcagaagccgcgcgacctgatcgcgcgggggtcgaggagaggggaaagcgcgcgccccggttgcctgccancgtaccgccgcaggagaaggaagaaggagcccgtatccctccgccccgctgcccgccgggacgattgactccgagcactggatctcccggcctggccgccgcgaaacgcttctaaaccggggcaatttcggcacanggattgggcccgggattgacaaactggagatggacaaaaaggggcaggcccccaatttcccttggccctactggtataaagaaacccacaattggaatccccctttggggccctggggggagggaggaccccttgaaaaaccaaaaccccgggctgggcccgttttggtttaaaaaggggttcaaaaagaat

SEQ ID NO: 37489 - DNA, 571 bp, Zea mays
  misc_feature: Ceres CLONE 1423412-F
  misc_feature (289)..(289): n is a, c, t, g, unknown, or other
  misc_feature (295)..(295): n is a, c, t, g, unknown, or other
  misc_feature (302)..(302): n is a, c, t, g, unknown, or other
  misc_feature (332)..(332): n is a, c, t, g, unknown, or other
  misc_feature (356)..(356): n is a, c, t, g, unknown, or other
  misc_feature (363)..(363): n is a, c, t, g, unknown, or other
  misc_feature (392)..(392): n is a, c, t, g, unknown, or other
  misc_feature (399)..(399): n is a, c, t, g, unknown, or other
caaagctggagctccaccgcggtggcggccgctctagaactagtggatcccccgggctgcatgtaattcgcacgagaccattacctagaacatcctaatcgaaaactcgaaaccctagcgccggcgcctccacttcgttttcctcactctctcctccagctcagggtccggcggcgaagggaaggcaagatgtacaccgcgaggaagaagatccagaaggagaagggccttgagccctccgagttcgaggactcccgttgcccaggctttctttgatctggagaacggnaaccangagctcnagagcgacctcaaggacctgtacatcaacnatgctatccagatggatgttaccnggagcangaaagcctgtgtcaatcacgtcccataangcctgcncaaggccttcaagaagatccatgtcaaactcgtcagggaactggaagagaaaatcagcggccaggatgtggtaaatggttgctccaaggagaatgtggagggccccccagaaaggtttcaccggttctgccccctcccacccagaaacctgaactggtggttaccaatggcc

SEQ ID NO: 37490 - DNA, 663 bp, Zea mays
  misc_feature: Ceres CLONE 1423430-F
  misc_feature: Encodes the peptide sequence at SEQ ID NO. 37491
  misc_feature (288)..(288): n is a, c, t, g, unknown, or other
acaagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacnaggccgccgccgccgtggaacccaagttctaccctgccgacgacgtcaagccccgcgttcccagcacccgcaagcctaagcctaccaagctcaagtcgagcatcacgccctgggacggtgctgattctcctcgcaaggcgctttcatggggaagagagatggtgttttctcaagcagctcaaggcttgccctgctccttatctctggggcctttcaagatcaatggagtaccgatcccgccgtgtggaccagaactatgtcaatgctacatcaacccaaggttgacatctctggtgttgaagtcccccaagtttgaagaacaatacttttgcaggggaaaaaaaccaaaaggggaaaaaaacgagggcgaacttt

SEQ ID NO: 37491 - protein, 165 aa, Zea mays
  misc_feature: Ceres CLONE 1423430-F
  misc_feature (1)..(49): Pfam Name: Ribosomal_L6e_N Pfam Description: Ribosomal protein L6, N-terminal domain
  misc_feature (41)..(41): Xaa is any aa, unknown, or other
MAPTSKLSTGIKRASRSHTYHRRGLWAIKAKNGGAFPKADXAAAAVEPKFYPADDVKPRVPSTRKPKPTKLKSSITPWDGADSPRKALSWGREMVFSQAAQGLPCSLSLGPFKINGVPIPPCGPELCQCYINPRLTSLVLKSPKFEEQYFCRGKKPKGEKNEGEL

SEQ ID NO: 37492 - DNA, 734 bp, Zea mays
  misc_feature: Ceres CLONE 1423440-F
  misc_feature: Encodes the peptide sequence at SEQ ID NO. 37493
aaagctggagctccccgcggtggcggccgctctagaactagtggatcccccgggctgcaggaattcgcacgagaccattacctagaacatcctaatcgaaaacaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgagttcgaccggctgagcgcgctcggcccggtggccaccctcgccggctcgcagtacacgctgaacctcacctacgacatgggcaccgtccgcgtgaagtccatgtggtccgaccccagatcagcagc

SEQ ID NO: 37493 - protein, 177 aa, Zea mays
  misc_feature: Ceres CLONE 1423440-F
  misc_feature (64)..(170): Pfam Name: Fasciclin Pfam Description: Fasciclin domain
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFANLTQDQLRSLLLCHALPKYYSLAEFDRLSALGPVATLAGSQYTLNLTYDMGTVRVKSMWSDPRSA

SEQ ID NO: 37494 - DNA, 738 bp, Zea mays
  misc_feature: Ceres CLONE 1423443-F
  misc_feature: Encodes the peptide sequence at SEQ ID NO. 37495
  misc_feature (696)..(696): n is a, c, t, g, unknown, or other
aagctggagctccccgcggtggcggccgctctagaactagtggatcccccgggctgcaggaattcgcacgagaccattacctagaacatcctaatcgaaaagacgacactgcacacctctcaccagtccccacacggccacaccacacccagctgtccccatcgcgcgcacactctctcggtctctccctcccagtcccagcgtttgcggtccagtccagagagctcgagcagccatggcggctcccctgttcctcctcctcctgctgctggctatgttcacaggctcagcagacgcggcgttctgcgtgtgcaagacgggcgtgcccgaccaggcgatgcaggcggcgatcgactacgcctgcgccaagggggccgactgcgcctccgcctccaagggcgcgccctgctacggcaacggcaacaaggtggccgtctgctcctacatctgcaacagctactaccagagccgcagcgccacgggcgccacctgcgacttcaacggcgtcgccacgctcaccggcaccgaccccagctccggcaccggggaggtcaccacccttttcttccttggagggaaataacacctcccacgagggggggggggggggggccacaaaaaaaaaaaaaaataaatctaaccggctttatttttttctcttctccgcgggagaaagaaaaaaaaaaaaaaaagatncttcttttctttttttttttttgtcgcgtcctcccccccttt

SEQ ID NO: 37495 - protein, 115 aa, Zea mays
  misc_feature: Ceres CLONE 1423443-F
  misc_feature (22)..(106): Pfam Name: X8 Pfam Description: X8 domain
  misc_feature: SWISSPROT Homolog: EC 3.2.1.39 Glucan endo-1,3-beta-D-glucosidase
MAAPLFLLLLLLAMFTGSADAAFCVCKTGVPDQAMQAAIDYACAKGADCASASKGAPCYGNGNKVAVCSYICNSYYQSRSATGATCDFNGVATLTGTDPSSGTGEVTTLFFLGGK

SEQ ID NO: 37496 - DNA, 702 bp, Zea mays
  misc_feature: Ceres CLONE 1423446-F
  misc_feature: Encodes the peptide sequence at SEQ ID NO. 37497
  misc_feature (467)..(467): n is a, c, t, g, unknown, or other
  misc_feature (534)..(534): n is a, c, t, g, unknown, or other
aagctggagctccccgcggtggcggccgctctagaactagtggatcccccgggctgcaggaattcgcacgagaccattacctagaacatcctaatcgaaaaatcacataagtccgccgcccctctccctcagtaaacccccctctcttcttcccgcggtctgctcgttcgatctgtgcagcagatctgaggtctcgagcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaagggtcctgttctggagactcctgatggcccctgttttgagagtaatgctatcgcacgctatgttgctcgcttgaaggatgacnaccctctttttggggtctcccgtattgaacaagcccacgttggagcaatggatggattttgccccancagaaagtgaatccgggggttgcatgggactgtttcccaaggcttgggtacctcccctatgtcaccccacttgaggaaaccccttttcctccttgaaaaagtccctgggggttttaaaacaacccttgcctaaacaaaaactttggggggaaggcggttacccaggaa

SEQ ID NO: 37497 - protein, 105 aa, Zea mays
  misc_feature: Ceres CLONE 1423446-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
  misc_feature (81)..(81): Xaa is any aa, unknown, or other
  misc_feature (103)..(103): Xaa is any aa, unknown, or other
MALVLHSGAGNKNAFKALIAAEYSGIKVELTKDFEMGVSNKTPEFLKMNPLGKGPVLETPDGPCFESNAIARYVARLKDDXPLFGVSRIEQAHVGAMDGFCPXRK

SEQ ID NO: 37498 - DNA, 727 bp, Zea mays
  misc_feature: Ceres CLONE 1423450-F
  misc_feature (477)..(477): n is a, c, t, g, unknown, or other
  misc_feature (526)..(526): n is a, c, t, g, unknown, or other
aaagctggagctccccgcggtggcggccgctctagaactagtggatcccccgggctgcaggaattcgcacgagaccattacctagaacatactaatcgaaaaatccgttgatcccatcggcttccccttcctcttcctcgatccccttcctcccccgatcccatccaattccacttccacaccccgggcctcgccgccgacgccgacgccgacgccgccggccatgtccaagtacggcaccattcccacctcctcctccgcgggcggagggcccgtgcccctcggcggcgcctccccgctcgatttcatctcccgcgccaggctcggggcgcctcggcgctggcgacgcgcccggcctggcgcgagctcgtggacgtccacgccgtcggcctgcccccgagcctcggcgacgcgtacctccgcgtgcggcgccaactcgcccacttttgccatgaactacgccatcggcgtcctagncgtcggtctccctctccctcctttgggaccccgtctccctaatcggtcnccccggttggatggccgcccggggtcgcccctaatttcccccgggaaaaagccccttccccttttggggcgggttttccccaaagggtaaatttcctcccggggtccccggtttaaaccttttttttagttcctcctcacggagcccccccgaaaaatttctttccccggggtttaaaggggccccccccccccccccccc

SEQ ID NO: 37499 - DNA, 746 bp, Zea mays
  misc_feature: Ceres CLONE 1423452-F
  misc_feature: Encodes the peptide sequence at SEQ ID NO. 37500
  misc_feature (620)..(620): n is a, c, t, g, unknown, or other
  misc_feature (699)..(699): n is a, c, t, g, unknown, or other
aaactggagctccccgcggtggcggccgctctagaactagtggatcccccgggctgcaggaattcgcacgagaccattacctagaacatcctaatcgaaaaaattcggacagccacctgctcggcgagccatggccggccgccgcgaaggcgagcaccaggcgagcccgtggcgatccgggacgcccgcggcggaggaggactcgggcgccttcccctccgccatcatcttcttcgctctcgttggcgctaccgccaccaccgccgccgtcggacaactgcgccggacggtcagctggttctacactcaacttagtaggtcggaaccatatgttttctgggaagacatacctcgtcgaccaaatcgtcatcggtgcggtgaagcctgggaacgatatcaccagaggatgcgtgacaggaccgaggatcaaagggaaagagtggtggcaatcgcgttgggagtcgagccagtcgacaccgaccactggattggacgaacttgtccatatcaaccccaacacgggaacgcatacggcacatgcaagatgtttttaataacgaagagagtaaacggcgggaattatcgaactttgggaagccctattccccaaaggcgccccncttcctggcagaaaattcaccgctccggcggcccacaagacctttgtttgccgcattcgaggcgccaagtttccggcgncgagtaagcctggagcccctttatagggacaggggtcccgccgcctg

SEQ ID NO: 37500 - protein, 191 aa, Zea mays
  misc_feature: Ceres CLONE 1423452-F
  misc_feature (164)..(164): Xaa is any aa, unknown, or other
  misc_feature (190)..(190): Xaa is any aa, unknown, or other
MAGRREGEHQASPWRSGTPAAEEDSGAFPSAIIFFALVGATATTAAVGQLRRTVSWFYTQLSRSEPYVFWEDIPRRPNRHRCGEAWERYHQRMRDRTEDQRERVVAIALGVEPVDTDHWIGRTCPYQPQHGNAYGTCKMFLITKRVNGGNYRTLGSPIPQRRPXSWQKIHRSGGPQDLCLPHSRRQVSGXE

SEQ ID NO: 37501 - DNA, 732 bp, Zea mays
  misc_feature: Ceres CLONE 1423457-F
  misc_feature: Translation starting site: 635
aaagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagctaaaatactttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgccttgaactctgcttcggggcttgtcctcgctcacgtgcctcgccaacacggcgcggcaggcgttccagcgcaccccggactacgtggaggaggcgcaccgcaggatggcggaggccgcggcgcacgcgggccacaagaccgcgcaggcaggccaggccatccagggcaggccgcatgaggccggcgccgggggaggtgcagg

SEQ ID NO: 37502 - DNA, 734 bp, Zea mays
  misc_feature: Ceres CLONE 1423467-F
  misc_feature: Encodes the peptide sequence at SEQ ID NO. 37503
aaagctggagctccccgcggtggcggccgctctagaactagtggatcccccgggctgcaggaattcgcacgagaccattacctagaacatcctaatcgaaaagtacgcaaagccccatacctcaataccggtgccgccttcgcctcgcactacacctctccctccctccgcctccatctccttcgccaccagaacccaagcgctgccccacacgccgccgcagcccgcacgggagccgcgcgccgcaccaaaaccctaggtctcctccgtcccccgatccatcgccttcatggccgcgccgcaacctgtcgcccaggcccccgaggcaccgccgtctgcgcaagtggtgggcaacgcgttcgtgcagcagtactacctcgtgctgcaccagtcaccggatctggtgtaccgcttctatcaggaggctagtcgcctcggccgccccgcatccgccgccggagccgccggcatggactccgtcaccactatggaggcaatcggcgagaagataatggagatggacgtgtcaaaagcggagatcaggacggtggactcgcaggagtcgcttggcggcggcgtcactgtgctcgtcacaggccacctcaccggccgtgacggagtgcgccgcgagttctcgcagtccttcttcctggcgccgcaggagaagggctacttcgtgctcaacgacatgttccgcttcgtcggggaaatccctgcccctaccgctgtagagg

SEQ ID NO: 37503 - protein, 148 aa, Zea mays
  misc_feature: Ceres CLONE 1423467-F
  misc_feature (20)..(137): Pfam Name: NTF2 Pfam Description: Nuclear transport factor 2 (NTF2) domain
MAAPQPVAQAPEAPPSAQVVGNAFVQQYYLVLHQSPDLVYRFYQEASRLGRPASAAGAAGMDSVTTMEAIGEKIMEMDVSKAEIRTVDSQESLGGGVTVLVTGHLTGRDGVRREFSQSFFLAPQEKGYFVLNDMFRFVGEIPAPTAVE

SEQ ID NO: 37504 - DNA, 708 bp, Zea mays
  misc_feature: Ceres CLONE 1423469-F
  misc_feature: Translation starting site: 162
  misc_feature: Pfam Name: TOM20_plant Pfam Description: Plant specific mitochondrial import receptor subunit TOM20
  misc_feature (258)..(258): n is a, c, t, g, unknown, or other
  misc_feature (266)..(266): n is a, c, t, g, unknown, or other
  misc_feature (342)..(342): n is a, c, t, g, unknown, or other
  misc_feature (349)..(349): n is a, c, t, g, unknown, or other
  misc_feature (357)..(357): n is a, c, t, g, unknown, or other
  misc_feature (358)..(358): n is a, c, t, g, unknown, or other
  misc_feature (380)..(380): n is a, c, t, g, unknown, or other
agagctggagctccccgcggtggcggccgctctagaactagtggatcccccgggctgcaggaattcgcacgagaccattacctagaacatcctaatcgaaaactagcccccgaatcagatcccaccgcccgccggagcgcggaaccctgcccccggccgccatggacatgagcgatgcggagcggctgttcttcttcgagatggcctgcaacaactccgaggtcgcgtacgagcagaaccccaacgacgccgacaacnttgacgcngatgggggcggaagcgctgctggagctatcgcagctgcgtaacggccccgacagcttcaagctcctccaagatgcngaagccnagctgganngagcactgcaaattgatccccnacagtctgatgcactctggtgcttgggaaatgctcagacttctcatggaatcttcactccgacactgcaattgcaaatgatttctttgcgaaggcaactgaatgttcccaaaaggctgcctgatgtgaaacccgcaaatgaccttgacaggaagtcctttaaactttttccccaaaggcccctagaccgccccccggaaaaccccagggaatgggttttttaaggggggaaaaaaaatttccccccctcttattcccccgctttccggggaaaaaaaaaaaaaggccccccctcttttgggacaaattttgtggggggggggcccccc

SEQ ID NO: 37505 - DNA, 639 bp, Zea mays
  misc_feature: Ceres CLONE 1423476-F
  misc_feature (306)..(306): n is a, c, t, g, unknown, or other
  misc_feature (458)..(458): n is a, c, t, g, unknown, or other
caaagctggagctccccgcggtggcggccgctctagaactagtggatcccccgggctgcaggaattcgcacgagaccattacctagaacatcctaatcgaaaattaaaaacctctgctcgggcctagggtttcctcccagtcgtcatcgcttggcgtccgcctcagcccgccgccaggagagccggctcggtcggttcgtcgaagatcccggatctgctctgtcacgaggtctttcggcgggtgttgtctcgcgaggtgtagcgagccaagttcaggagagtttcgagaagctgaaatggctcctnaagctgctcctgcccagaagggtgatgccaagacccagggccttgaagggttgcaagggctgtgaagtctgggtcagtaaagaagaccaggaagatccgcacgtccgtgacatttcaccgcccccagaccctgaagaaagctagggaccccnagtaccccagatcagcactacccggaaggaacaagcttgatcagtacaaaattctcagtatccccctcccccagaatcggccatgaaaaaaatttgaaaatacaaccctcttgtctttcatgtcaacctcagggcaaacaaaaaaaaatcaagggttgttgcaagaaaatgtttgaatttt

SEQ ID NO: 37506 - DNA, 776 bp, Zea mays
  misc_feature: Ceres CLONE 1423479-F
  misc_feature: Encodes the peptide sequence at SEQ ID NO. 37507
  misc_feature (776)..(776): n is a, c, t, g, unknown, or other
atagctggagctccccgcggtggcggccgctctattactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgactacctcaccggcacgaccgcggctgccaacaacatgatggacatacactcactcatcatgtctttgaacttcacccaaattgagatcaagactgccaattttgtgaactcatggggcgatggggtgctagttatggtctctggtctagtgcagaccaaggagtacagccaccacaggaaatttatccagatgttcttccttgcccctcaagagaagggttactttgtcctcaaacattactttcacttcgttgaccaaaatactgggccagctgggccgagttcctgaaggcatcagttgcagcccgaccggctacccccctacctgctcgccctcagatgccagtcctttgccggcaagcagtggttgcccagcagcctcaaggcaagttgggaagccccccaacacccgggtaaccagggcagaatccttccggccttgggtcccctcccaagtccattccctgccagtcaaccaacn

SEQ ID NO: 37507 - protein, 138 aa, Zea mays
  misc_feature: Ceres CLONE 1423479-F
  misc_feature (10)..(126): Pfam Name: NTF2 Pfam Description: Nuclear transport factor 2 (NTF2) domain
MASAAAATQVGTYFLRNYYNLLQQTPDVVHQFYSEASTMVRVDYLTGTTAAANNMMDIHSLIMSLNFTQIEIKTANFVNSWGDGVLVMVSGLVQTKEYSHHRKFIQMFFLAPQEKGYFVLKHYFHFVDQNTGPAGPSS

SEQ ID NO: 37508 - DNA, 679 bp, Zea mays
  misc_feature: Ceres CLONE 1423482-F
  misc_feature: Encodes the peptide sequence at SEQ ID NO. 37509
agtggatcccccgggctgcaggaattcgcacgagaccattacctagaacatcctaatcgaaaaactaaactagtgcggggtataaagctctctccctccgcgcttccgaacagttcacgacgactccaggaggggcgcacttgactttcccctcctcctcctgcgagcaccttcctcgcctcgctctcatggcctcatcagagcctatagagtgccaggttgtggcgctgagggtgtcgattcactgccaaggatgcaagaagaaggtgaagaaggtgctccagaacatcagcggcgtgtaccgatgcgaaatcgatgcccggagcaacaaggtcgtggcgacggtctcgacggagctcgacccctacatgctggtcgccaagctgcccaagtccggcaagcaggcggagctgtggccggagcagccggtgcagcagcaggagcagccggcaccaccagctgagagccaaaggcaagaggagcccaagaacaaccagcctgcggagccgggcagacccagcgaacctgccgaggagcgcggcgccgccgccgacacggccgaggccgccgcggctgaccccagcaacccgcaaccttcgccgccggagcccaacccgagcgccggcggagaggccacaaatccggcgggcccagacagcaaagacaacgccagccgcga

SEQ ID NO: 37509 - protein, 163 aa, Zea mays
  misc_feature: Ceres CLONE 1423482-F
  misc_feature (13)..(75): Pfam Name: HMA Pfam Description: Heavy-metal-associated domain
MASSEPIECQVVALRVSIHCQGCKKKVKKVLQNISGVYRCEIDARSNKVVATVSTELDPYMLVAKLPKSGKQAELWPEQPVQQQEQPAPPAESQRQEEPKNNQPAEPGRPSEPAEERGAAADTAEAAAADPSNPQPSPPEPNPSAGGEATNPAGPDSKDNASR

SEQ ID NO: 37510 - DNA, 683 bp, Zea mays
  misc_feature: Ceres CLONE 1423501-F
  misc_feature: Encodes the peptide sequence at SEQ ID NO. 37511
  misc_feature (683)..(683): n is a, c, t, g, unknown, or other
ctccccgcggtggcggccgctctagaactagtggatcccccgggctgcaggaattcgcacgagaccattacctagaacatcctaatcgaaaaatcttactggcgcccaagctctccacgccagccatctcccctccatcttcccttctgcagaaatcctaccatggccgccctccctggtgctcaccccagtcgaggtctctccatggccggctgtagttccctggcgcccctgctcctccctgttctagctcggtgctcagagccccagcgccagtcgcccttctgctcccttccccatggcgcgcttgctccctagacggcgctcggattcctccttctcggccctctccatcgcgccctgctcgcccagccgcgccgagctcggcctcttcttctcccctgctcctatggcggcgccggtcggatctccctggcgcctcaccctgctctctatctgcccatgaagtcgcctagcccaaccgtgcctgctccctcactgtgctcgccatggtcgccgcctccaagcttctccctgctgcgcctgtggccgtcccctctgctcgccacgacgtgtcgagctcccgcgtcgagtccttttcctgctcgcccgcgatgcccggcgtcctgcctgctctgctcgccatccgtccatgcgtcatgcgtggagcaacagaggaaaan

SEQ ID NO: 37511 - protein, 57 aa, Zea mays
  misc_feature: Ceres CLONE 1423501-F
MVAASKLLPAAPVAVPSARHDVSSSRVESFSCSPAMPGVLPALLAIRPCVMRGATEE

SEQ ID NO: 37512 - DNA, 654 bp, Zea mays
  misc_feature: Ceres CLONE 1423506-F
  misc_feature: Encodes the peptide sequence at SEQ ID NO. 37513
  misc_feature (547)..(547): n is a, c, t, g, unknown, or other
aaagctggagctccccgcggtggcggccgctctagaactagtggatcccccgggctgcaggaattcgcacgagaccattacctagaacatcttaatcgaaaagcgaggtcgaaatccccaaggcgaggcgttgaaacccttaaccctcttccacctcgaagcggcgcgaggagggagagtgtgagtggactcaggaggcggcgggcgaaatgaagcttaacgtcaagaccctcaagggcaccaacttcgagatcgaggcgagccccgatgcgtcggttgctgaggtgaagaggatcatcgaaactactcagggtcagagtacctacccagcagaccagcaaatgctcatataccaagggaaaattctgaaggatgagaccactttggaaagcaacggagttgctgagaacagcttccttgttataatgctgtccaagggctaggcatcctcaagtggagcttccacccgctactgctggcaaagcgtcctgcactccagcccaacctggctgcccctggcacatcagttgtaaggacaccctacccnagctcctggtggcacagcctgaaacggcccctcccagtggcaaaaactcagggtggtcccgcgtgctaaccgctggctgctccgaagatggtgatgtggccggcccg

SEQ ID NO: 37513 - protein, 77 aa, Zea mays
  misc_feature: Ceres CLONE 1423506-F
  misc_feature (6)..(78): Pfam Name: ubiquitin Pfam Description: Ubiquitin family
MKLNVKTLKGTNFEIEASPDASVAEVKRIIETTQGQSTYPADQQMLIYQGKILKDETTLESNGVAENSFLVIMLSKG

SEQ ID NO: 37514 - DNA, 753 bp, Zea mays
  misc_feature: Ceres CLONE 1423514-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (111)..(111): n is a, c, t, g, unknown, or other
  misc_feature (126)..(126): n is a, c, t, g, unknown, or other
  misc_feature (127)..(127): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (389)..(389): n is a, c, t, g, unknown, or other
  misc_feature (425)..(425): n is a, c, t, g, unknown, or other
nnnnnnnnnnnnnnnnnnnnnnnnnnnnnnnnnnnnnnnnggggnnnnnnnnnnnnnnnnnnnnnnnnnnnnnnnnnnggggnnngggggggggggggggggcctgctctnccgctttgggggggnncccctctaatgttgggctccccnnnnnnnnnnnnnnnnnnnnnnnnnnnccaaactgggactccaccgcgtggcggccgctctagaactagtggatcccccgggctgcaggaattcgcacgagaccattacctagaacatcctaatcgaaaacttccattcacccgcagctcccatcctctcgctcgccaggagaagcagccgccgttgctgctgccgcgtccacagaatgggggggttcgtgaaagaccatagacaatgcngtattcaacgtttccaagtgaaaattcagagaagcnggctggcagacagactacagggccaggataggctggatttaccagaccaaaaacaggtccacacaccccaaatcggattggttgggggatttacccacaagggattccctggccaaaactaattctgctaaaaaaagcggggaaaaggggtctttggcttcggcccactcccccaaatttccccaaaaaagggccttaaaaatggggttacaacaaaaattggcagggccccacggggcagggaaattttttggggccccgccgggggcgaaaaaaaacccggggttttgaaaaaaaggaggtttaggggggctttttttaagccccc

SEQ ID NO: 37515 - DNA, 704 bp, Zea mays
  misc_feature: Ceres CLONE 1423515-F
  misc_feature: Translation starting site: 252
  misc_feature: Pfam Name: Coatomer_E Pfam Description: Coatomer epsilon subunit
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (580)..(580): n is a, c, t, g, unknown, or other
  misc_feature (582)..(582): n is a, c, t, g, unknown, or other
  misc_feature (585)..(585): n is a, c, t, g, unknown, or other
  misc_feature (590)..(590): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacctagaacatcctaatcgaaaaaattacaagtataactccattcccctccgtcctcccgcatcaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccacggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctcagaagtgaggttgatggatcagcattggaagcatccntngtnctgcngtgantggctgggaatgtatttatgcatgagcagggactacatgagggctctcagccacacactctgaggaactcctgatttgcatgcattgaaatgtccagatctcatcaaag

SEQ ID NO: 37516 - DNA, 686 bp, Zea mays
  misc_feature: Ceres CLONE 1423528-F
  misc_feature: Encodes the peptide sequence at SEQ ID NO. 37517
  misc_feature (605)..(605): n is a, c, t, g, unknown, or other
  misc_feature (639)..(639): n is a, c, t, g, unknown, or other
  misc_feature (641)..(641): n is a, c, t, g, unknown, or other
aagctggagctcaccgcggtggcggccgctctagaactagtggatcccccgggctgcaggaattcgcacgagaccattacctagaacatcctaatcgaaaaacatcatcggtctcctcctcctccccgtgcatagcactcgccggggcttcctacaacttcaaaatggcggctaccgccaccgccatggctatcacgactatgtcccccgacgatccgataacgtccgtgcccttgcaatcccttgagctcaccctcggcctccgactgcgatcttaaccactcctctaaccttcttcccgcagccgcttccgtcctagttccaaagccgcgctctgtgacgaatccgtccccggagatggtaggagatgttcaggaaatcgttgcccctggagacgaaaaggactaagaagagaaacagcgggcccagtcggggttctccttccgagtaacaatacggggggacaacacgaggggtacctccagccccgagcccttggacttactaatccaccggaatccccaagaatacatttgggggccgcgtaggggaaactcttataagggccatatctctttctgcggctagcacattgtctggggggnaccaatctaccctacaaaaaaccaaccggggggngncccccctataaaccttggggaccccgcgccaccaccaaccccgaa

SEQ ID NO: 37517 - protein, 37 aa, Zea mays
  misc_feature: Ceres CLONE 1423528-F
MAATATAMAITTMSPDDPITSVPLQSLELTLGLRLRS

SEQ ID NO: 37518 - DNA, 634 bp, Zea mays
  misc_feature: Ceres CLONE 1423541-F
  misc_feature: Encodes the peptide sequence at SEQ ID NO. 37519
ctggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaggctctgaagtcccctttgatgggcctattcgagaagcgcagagcaaggaacttcttcatttatgtccaagattacaatgaagctgatcc

SEQ ID NO: 37519 - protein, 153 aa, Zea mays
  misc_feature: Ceres CLONE 1423541-F
  misc_feature (1)..(153): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEAD

SEQ ID NO: 37520 - DNA, 632 bp, Zea mays
  misc_feature: Ceres CLONE 1423543-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (330)..(330): n is a, c, t, g, unknown, or other
  misc_feature (592)..(592): n is a, c, t, g, unknown, or other
  misc_feature (593)..(593): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactggaactccccgcggtggcggccgctctagaatagtggatcccccgggctgcaggaattcgcacgaagaccattacctagaacatcctaatcgaaaaactactccgtcactttgtttgcaaagctcctcctcgatccatcgatcactgcaccggccggcggcaccgcgctcggcagggctagcccaacgagacggcagcaatgggcnggaccgtggaccgcaagggcatttcacggggggcccccagcccaccttacgggaagaaacaacaacaggggagaaagcggggcgccccccaatggggggaaacccgggaaaaggggtatttccccccccaaaagagggggccacaaaagggttccaagggggcttaaaaagggggggacaactttttcccccctggggggtcttcttttgtgtttttttggggggtgggttaaaaacccccccccggggggggggggtttcnnaacccccccccggttttttttaaatatttcccccccgcc

SEQ ID NO: 37521 - DNA, 645 bp, Zea mays
  misc_feature: Ceres CLONE 1423546-F
  misc_feature: Encodes the peptide sequence at SEQ ID NO. 37522
aaagctggagctccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcatgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccccgcccctcctccagtcgatcccatggattaaccacttccccaagacccccgaccggcgagtgggttcgagaccgacgcgggggctcaggggtcaagcctcagcaaatttcctctttttccaccatccctcggcggttatattgggccggggataaagggaccaggaaggacccccgggggccaggatccacctccggcgggaatgggaagggccaagatattttccctgcc

SEQ ID NO: 37522 - protein, 104 aa, Zea mays
  misc_feature: Ceres CLONE 1423546-F
MWAASCLASCCAACACEACRTAVGSIGRRSARIAYCGLFALSLFASWALREVAPPLLQSIPWINHFPKTPDRRVGSRPTRGLRGQASANFLFFHHPSAVILGRG

SEQ ID NO: 37523 - DNA, 627 bp, Zea mays
  misc_feature: Ceres CLONE 1423548-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (153)..(153): n is a, c, t, g, unknown, or other
  misc_feature (310)..(310): n is a, c, t, g, unknown, or other
  misc_feature (323)..(323): n is a, c, t, g, unknown, or other
  misc_feature (343)..(343): n is a, c, t, g, unknown, or other
  misc_feature (366)..(366): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggggctccccgcggtggcggccgctctagaactagtggatcccnccgggctgcaggaattcgcacgagaccattacctagaacatcctaatcgaaaacccgtccctctcccacccttttcagatctgcctgcgagcccccgccacgcacccccatgcccatgcggccatgcccatgaccccccgacgcgagggcactactngcaatggctcccntgcgtgaccgagcccatggnagacctcgcccgggggccctcgnactcctccgcgccgtcgctgaataaataaagaactccgttctggttgcccgggggccggattcccccccccgaaccccaatccccccccggaagtccttgttccaaatggaaaaaggtcccccccccaaattttaaggggtttccccaacccccccccccccctttggtttaaaaaaaatttttttcccccggtttttgcttttggtttttgaaaaattttttccccccccttccggggccaaaggggccccccaaaaaac

SEQ ID NO: 37524 - DNA, 669 bp, Zea mays
  misc_feature: Ceres CLONE 1423564-F
  misc_feature: Encodes the peptide sequence at SEQ ID NO. 37525
  misc_feature (356)..(356): n is a, c, t, g, unknown, or other
  misc_feature (502)..(502): n is a, c, t, g, unknown, or other
aaagctggagctccccgcggtggcggccgctctagaactagtggatcccccgggctgcaggaattcgcacgagaccatacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgntgcgagtggcagtacggaaaggacaccccgcggaagagggaatgcgagagcgagtgccgcgagcggcaccagcaagctgacgcgggcgaagacggcgacagcggcgtggacgcctacgtctcccgctccgggaggggcgagtgccngccccagtgcctgcgccgccacgagggcccagcgtgggagacccaggagtgcatgaggcggtggccccgccccggactggccttcaactggaacaagattacggtcccgcaaccaaaaaccgggcaaatgccgggaaaagtgcaacgccccccccccgggggatggg

SEQ ID NO: 37525 - protein, 74 aa, Zea mays
  misc_feature: Ceres CLONE 1423564-F
  misc_feature (49)..(49): Xaa is any aa, unknown, or other
MGKGSVGASWWAFLLLAGVLLVVAATAGAEDGVVERDRKEDLRWCKQAXRVAVRKGHPAEEGMRERVPRAAPAS

SEQ ID NO: 37526 - DNA, 655 bp, Zea mays
  misc_feature: Ceres CLONE 1423565-F
  misc_feature: Encodes the peptide sequence at SEQ ID NO. 37527
  misc_feature (52)..(52): n is a, c, t, g, unknown, or other
  misc_feature (124)..(124): n is a, c, t, g, unknown, or other
  misc_feature (143)..(143): n is a, c, t, g, unknown, or other
aaagctggagctccccgcggtggcggccgctctagaactagtggatcccccngggctgcaggaattcgcacgagaccattacctagaacatcctaatcgaaaaaaaaaaaaaaaaaaaaggcgngagaagccaacgataccantccttgctcaaaaattcaaactccgataacctctcacgcgcctccctacgcgcaacgatcccaaattttcaaacgatggagccggcgaaggtagattccgatgcgaagactgtcaaggatccgaatccgagcgccgatccgaaagccgcggatcaaggaccggcgaagaaggtaggcgaggacgcgaacgccgagatcgccttgtcggaggtcgaaatcgagacgaaagggatcgatccagcagcggcgcaggcggaagcgcagccgccggcgaggacgtcgtctggatcgaagaaatcggtgcactggagccccgagctggtgtccgggtctcaggagccggatcagaagtccgcttcgtcgtacccggcgggatctaatccgtatattgctcgttctccggctgagacgtcggatgcttccttgaaagatacgatggagtctgtgaaaggagcgcttgggagatggggaaggagggttgctgaagctgctaagaagacggagagccttgc

SEQ ID NO: 37527 - protein, 145 aa, Zea mays
  misc_feature: Ceres CLONE 1423565-F
MEPAKVDSDAKTVKDPNPSADPKAADQGPAKKVGEDANAEIALSEVEIETKGIDPAAAQAEAQPPARTSSGSKKSVHWSPELVSGSQEPDQKSASSYPAGSNPYIARSPAETSDASLKDTMESVKGALGRWGRRVAEAAKKTESL

SEQ ID NO: 37528 - DNA, 518 bp, Zea mays
  misc_feature: Ceres CLONE 1423567-F
  misc_feature (29)..(29): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (459)..(459): n is a, c, t, g, unknown, or other
aaagctggagctccccgcggtggcggccngctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcctgctgcccggcttgccccttgcaaagcctgcccggaaagggggtcgggaaaaatcgggccggccgttcccccccggaatggcccaaagggggggccctttttgggggtttcccccctttttttgaaacccggggggggccccccccaggggggggcnnnngggcgcccctttttttnccggggggaaccccccggggggggaaaaaaaccccctctccaaaaaaaaaaaacccccg

SEQ ID NO: 37529 - DNA, 708 bp, Zea mays
  misc_feature: Ceres CLONE 1423568-F
  misc_feature: Encodes the peptide sequence at SEQ ID NO. 37530
  misc_feature (528)..(528): n is a, c, t, g, unknown, or other
  misc_feature (529)..(529): n is a, c, t, g, unknown, or other
  misc_feature (641)..(641): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacaacaagtgtcccagatttnnagggaaagaggcgaaacccaaaacggcaacggctgcatcagcctggccagagttcgccgcgctcatggaagtcccgcgtccgccgacgcccgccgccgtcgaaggaggaccntgcgccacgcctttcatggtcttncgacgccgaacgggcaacggcctcatcacgcccgcccgagctc

SEQ ID NO: 37530 - protein, 156 aa, Zea mays
  misc_feature: Ceres CLONE 1423568-F
  misc_feature (56)..(84): Pfam Name: efhand Pfam Description: EF hand
  misc_feature (97)..(97): Xaa is any aa, unknown, or other
  misc_feature (142)..(142): Xaa is any aa, unknown, or other
MGKVRSFFSRSRSGKRGSARRAGSSSPHSSAASAPPSPSPLPRRSPSSSSTTTRDETERVFRKFDANGDGQISRSELAALFEGVGHAVTDNKCPRFXGKEAKPKTATAASAWPEFAALMEVPRPPTPAAVEGGPCATPFMVXRRRTGNGLITPARA

SEQ ID NO: 37531 - DNA, 649 bp, Zea mays
  misc_feature: Ceres CLONE 1423569-F
  misc_feature: Encodes the peptide sequence at SEQ ID NO. 37532
  misc_feature (492)..(492): n is a, c, t, g, unknown, or other
  misc_feature (526)..(526): n is a, c, t, g, unknown, or other
aaagctggagctccccgcggtggcggccgctctagaactagtggatcccccgggctgcaggaattcgcacgagaccattacctagaacatcctaatcgaaaaagttcctacgccgcggcggcgcggcctctccattccggtgtgttctccgatttgggggacgtcccttgcccgctccggagtccggtccagcggagccagctacggcacagatcggcttccgtccgccccttcccatctcaccagactctgcaccgccgcggtgatcgtgcctcggctgcttcctagattactgcttcaggccgtgctgatgcaaaatggttctatgtcagggcgttttctgttggaaatgctcagttgctagcttttcctggtagatcatcaagttttaagagcacccagtttcatgttaaaacggatcatttttctgcaagagctctacgtgctggcactgattccattcatcatggcatgtctacatcattcccaaanggagattctctcaagggcatcccatcactatcanggcagcataatcagcatcccaggtccgttagttgtccggcaggctcgctggcatctttcagctaccctgagctgacattcaacccagatggtgggtgagaactctagcttgtgtgccgtacct

SEQ ID NO: 37532 - protein, 50 aa, Zea mays
  misc_feature: Ceres CLONE 1423569-F
  misc_feature (7)..(7): Xaa is any aa, unknown, or other
  misc_feature (19)..(19): Xaa is any aa, unknown, or other
MSTSFPXGDSLKGIPSLSXQHNQHPRSVSCPAGSLASFSYPELTFNPDGG

SEQ ID NO: 37533 - DNA, 707 bp, Zea mays
  misc_feature: Ceres CLONE 1423573-F
  misc_feature: Encodes the peptide sequence at SEQ ID NO. 37534
  misc_feature (252)..(252): n is a, c, t, g, unknown, or other
  misc_feature (255)..(255): n is a, c, t, g, unknown, or other
  misc_feature (258)..(258): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaaactacgctccacgaacacgcacgtccgaacaattccatcctagctagctagcagttctcatcacgccaaccacctacgacgagcatggccgccagagcaagaacccacggccctctcttctccctcctccccctcctcctccaccaccanctngtnctcctcgcggtactcaccgtccgtaatagcagcagcagcagcagccggtgccccggcgtgccgtccatgacggcgcaccaggcgtgcagcgcggtggccgggacgcggcgcatgctggagctctgcctccgcaccctccgcggcggcgcgccgctgccggtgacccggcacgcatcggtggccgtgcgcggcccgctccactcgtacgcggccacggcggccgccactacatctctgctggactgcaggccggtgcctgccgacggcgacagggccgcgtccggccgctgcatggtgggctaccgcagcgcccgcgtcgacatggcgcgcgtcgacgccgatcgtctcgccgcctgctgcnacggcagcggcccccgggccgcggacctccaagcggggccacggtccgggctccatgggaggaatgcatgcctcggggcttgatcagg

SEQ ID NO: 37534 - protein, 125 aa, Zea mays
  misc_feature: Ceres CLONE 1423573-F
  misc_feature (99)..(99): Xaa is any aa, unknown, or other
MTAHQACSAVAGTRRMLELCLRTLRGGAPLPVTRHASVAVRGPLHSYAATAAATTSLLDCRPVPADGDRAASGRCMVGYRSARVDMARVDADRLAACCXGSGPRAADLQAGPRSGLHGRNACLGA

SEQ ID NO: 37535 - DNA, 751 bp, Zea mays
  misc_feature: Ceres CLONE 1423574-F
  misc_feature: Encodes the peptide sequence at SEQ ID NO. 37536
aagctggagctccccgcggtggcggccgctctagaactagtggatcccccgggctgcaggaattcgcacgagaccattacctagaacatcctaatcgaaaagacaccccctccgctctccttatcccttccattcgcccaaacccccgccgccgtgacccctgccagcccgcggccttcccctcgttctaggcttcaactgccggcctcgtgtcttctgggcaagtgaagagagagatggcgtcgccaataccgcgcgagtgggtcgggctgcagcagtttcctccggccacccagaccgagctgcacgagctcctcggcaagctcaaggaggaggatgtgagcacattgacaaattctgtgatggggaaaaggcgagtggggaagtcatctactgttaactccatcgtcgggggagagatcgccactgtcagcgcttttcagtctgagggtctgaaaccaatgattgtgtcccccaaagggcaagggtccactttgaacttatcgaaccctcctgggcttattgaagggggatcctttaatggagcgggtgttgaactccataaaaaaatatccttctgggaaaaacaattgaagtctcccccggaatggggaaccttttggatccccaccaaaaaggggaacccctttgggggacagggttaaaaaagacccccccccatttttttgggaaaaagatttttgggcgaaaaaccttggggttggtgtgcccctaggtcaaaatctcccca

SEQ ID NO: 37536 - protein, 142 aa, Zea mays
  misc_feature: Ceres CLONE 1423574-F
MASPIPREWVGLQQFPPATQTELHELLGKLKEEDVSTLTNSVMGKRRVGKSSTVNSIVGGEIATVSAFQSEGLKPMIVSPKGQGSTLNLSNPPGLIEGGSFNGAGVELHKKISFWEKQLKSPPEWGTFWIPTKKGNPFGGQG

SEQ ID NO: 37537 - DNA, 664 bp, Zea mays
  misc_feature: Ceres CLONE 1423585-F
  misc_feature: Encodes the peptide sequence at SEQ ID NO. 37538
  misc_feature (507)..(507): n is a, c, t, g, unknown, or other
  misc_feature (541)..(541): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggntgtcgccatcctggccggcgtggtgggcgccgcntcaagctggcgggcgtgcaccacgtgcgcccctgggccacgacagctggccacaacgccgcgtcgtccctcatcgcctggccatcacggccctcccttcgggctggcctgaaagaaatcccat

SEQ ID NO: 37538 - protein, 102 aa, Zea mays
  misc_feature: Ceres CLONE 1423585-F
  misc_feature (14)..(85): Pfam Name: AWPM-19 Pfam Description: AWPM-19-like family
  misc_feature (55)..(55): Xaa is any aa, unknown, or other
MAGIGRNMVAPLLVLNLIMYIIVIGFASWNLNHFINGQTNYPGVAGNGATFYFLXVAILAGVVGAASSWRACTTCAPGPRQLATTPRRPSSPGHHGPPFGLA

SEQ ID NO: 37539 - DNA, 635 bp, Zea mays
  misc_feature: Ceres CLONE 1423600-F
  misc_feature: Encodes the peptide sequence at SEQ ID NO. 37540
  misc_feature (52)..(52): n is a, c, t, g, unknown, or other
  misc_feature (269)..(269): n is a, c, t, g, unknown, or other
  misc_feature (483)..(483): n is a, c, t, g, unknown, or other
  misc_feature (512)..(512): n is a, c, t, g, unknown, or other
  misc_feature (515)..(515): n is a, c, t, g, unknown, or other
  misc_feature (520)..(520): n is a, c, t, g, unknown, or other
  misc_feature (539)..(539): n is a, c, t, g, unknown, or other
  misc_feature (550)..(550): n is a, c, t, g, unknown, or other
agagctggagctccccgcggtggcggccgctctagaactagtggatcccccngggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgnctcctgataactgctcaagaaggtacgtatgtacattatataatgcattggttgcttgctttgtttgtttattcatgcatgcacgtgtcatatatagttggcagcacatacacaaatgcaagctagctgctaactgagcaatgcaaaccttcttattgcattgcatgtcgatcagctggaggagacacgaggtgtggtcgtcgtcatcctcccnggccggtgtcgtgggtggcggcgccctcntcntcccnacggcccggatgggggccngacggtctccnttcctgttccgggggaagaaggccgttggtgttgtaccaagagcagcgcccaacccctctgggccaaggggcattcccgggctta

SEQ ID NO: 37540 - protein, 42 aa, Zea mays
  misc_feature: Ceres CLONE 1423600-F
ELELPAVAAALELVDPPGLQEFARDHYLEHPNRKVPCSKRKV

SEQ ID NO: 37541 - DNA, 711 bp, Zea mays
  misc_feature: Ceres CLONE 1423601-F
  misc_feature: Encodes the peptide sequence at SEQ ID NO. 37542
  misc_feature (596)..(596): n is a, c, t, g, unknown, or other
aaagctggagctccccgcggtggcggccgctctagaactagtggatcccccgggctgcaggaattcgcacgagaccattacctagaacatcctaatcgaaaatacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcangaagcttgcagataattgcactggtctccagggcttcctcgtcttcaacgctgttggtggaggaacgggctctgggcttggttctctcctcctggagcgcctgtctgttgactat

SEQ ID NO: 37542 - protein, 161 aa, Zea mays
  misc_feature: Ceres CLONE 1423601-F
  misc_feature (49)..(161): Pfam Name: Tubulin Pfam Description: Tubulin/FtsZ family, GTPase domain
  misc_feature (123)..(123): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIXKLADNCTGLQGFLVFNAVGGGTGSGLGSLLLERLSVDY

SEQ ID NO: 37543 - DNA, 645 bp, Zea mays
  misc_feature: Ceres CLONE 1423602-F
  misc_feature: Encodes the peptide sequence at SEQ ID NO. 37544
  misc_feature (645)..(645): n is a, c, t, g, unknown, or other
aaagctggagctccccgcggtggcggccgctctagatctagtggatcccccgggctgcaggaattcgcacgagaccattacctagaacatcctaatcgaaaaactggataattcgctcgctccgctcgatgcccgcttgtttggggtgaagtctccggccaacggacgtagcggaaacaccacccgagatgtctgctccctccgccccaccccgcacggagatctgtgtgggcgacgtccacggctacatcaccaagctggagagcctctggtccaacctcaaggccgcactccccgccgacgccttcgccaccgcgctggtcatcttcctcgaccactacaacgaccgcggcccgtacacccgcagggtcctagacttcctcctcgcgatcacgactcgctacaccgcgcagcgccacgtcttcctctgcgggaaccacgacatcaccttcacggcgttcgtcagggcgctgcctccacctcccgacggctccacgttctcggccacgtgggacgagtacatccacaacgaggagcacaaaccgtggatccacgagccgggatccgaggccatgcacgtgcagcggaggcgatgaggcgtactccctcaggagaaggtgcaacccccagaatggcctcccagtn

SEQ ID NO: 37544 - protein, 135 aa, Zea mays
  misc_feature: Ceres CLONE 1423602-F
MSAPSAPPRTEICVGDVHGYITKLESLWSNLKAALPADAFATALVIFLDHYNDRGPYTRRVLDFLLAITTRYTAQRHVFLCGNHDITFTAFVRALPPPPDGSTFSATWDEYIHNEEHKPWIHEPGSEAMHVQRRR

SEQ ID NO: 37545 - DNA, 638 bp, Zea mays
  misc_feature: Ceres CLONE 1423616-F
  misc_feature: Encodes the peptide sequence at SEQ ID NO. 37546
  misc_feature (481)..(481): n is a, c, t, g, unknown, or other
aagctggagctccccgcggtggcggccgctctagaactagtggatcccccgggctgcaggaattcgcacgagaccattacctagaacatcctaatcgaaaaatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcatcgtggatccacatccggtcgctcctcggcgccgccgcgtcctcgtcctcgtcctcctccttcgcagcggctgccgctgggaacgccgtggctgtggtgtccgctgcngtggcccgctcgtcttcctccttcgccgcgtcgtcctcgccgcactcggagcggggtgggtctaaatctccatggtccccgagaaaaagaaacgagcactttctcgtgaacagtgggagagtttgtttttcagcaatgggagcttcgtgatggtgga

SEQ ID NO: 37546 - protein, 28 aa, Zea mays
  misc_feature: Ceres CLONE 1423616-F
MVPEKKKRALSREQWESLFFSNGSFVMV

SEQ ID NO: 37547 - DNA, 682 bp, Zea mays
  misc_feature: Ceres CLONE 1423635-F
  misc_feature: Encodes the peptide sequence at SEQ ID NO. 37548
  misc_feature (1)..(1): n is a, c, t, g, unknown, or other
  misc_feature (412)..(412): n is a, c, t, g, unknown, or other
  misc_feature (420)..(420): n is a, c, t, g, unknown, or other
  misc_feature (422)..(422): n is a, c, t, g, unknown, or other
  misc_feature (423)..(423): n is a, c, t, g, unknown, or other
  misc_feature (433)..(433): n is a, c, t, g, unknown, or other
  misc_feature (437)..(437): n is a, c, t, g, unknown, or other
naaagctggagctccccgcggtggcggccgctctagaactagtggatcccccgggctgcaggaattcgcacgagaccattacctagaacatcctaatcgaaaaacaaacttcccctgtcacgagagtacgagaccacgccttctgtgggatcaatcggctagggtttcggagatgttcggccgcgcgccgaagaagagcgacaacacccggtactacgagatcctgggggtttccaaggacgcgtcacaggatgacctcaagaaggcctaccgcaaggccgccatcaagaaccaccccgacaagggcggcgaccccgagaagttcaaggagctagctcaggcttatgaggtcctcagcgaccctgaaaagagagagatctatgaccagtatggcgaggatgcccctcagganggaatggnanngcgtggtggnaatncataatccctttgaacttattccaggtcatcctttgggggggggaggcccttttggaaggggggcacctttaggggcaaaagggcaccccacgggaaattaaggggtttcccccccccaaaggtttcttgggggagtttttcaaagggcccctaaaaaaaatttttttttgccccaaaatgtctttgctcccagggaggagggggggcgtcccaagtggggcccccccgaaggggggggggttga

SEQ ID NO: 37548 - protein, 88 aa, Zea mays
  misc_feature: Ceres CLONE 1423635-F
  misc_feature (13)..(71): Pfam Name: DnaJ Pfam Description: DnaJ domain
  misc_feature (80)..(80): Xaa is any aa, unknown, or other
  misc_feature (83)..(83): Xaa is any aa, unknown, or other
  misc_feature (84)..(84): Xaa is any aa, unknown, or other
MFGRAPKKSDNTRYYEILGVSKDASQDDLKKAYRKAAIKNHPDKGGDPEKFKELAQAYEVLSDPEKREIYDQYGEDAPQXGMXXRGGN

SEQ ID NO: 37549 - DNA, 651 bp, Zea mays
  misc_feature: Ceres CLONE 1423639-F
  misc_feature: Translation starting site: 282
  misc_feature (390)..(390): n is a, c, t, g, unknown, or other
aagctggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccatagtgntttaaaaaggggtatgggtctaaccagaaggaccaaaggactgggcgtccaaaaatttggatatacagggacaaagttactaatgaaccaaagggtgatgcaacagtcaccctatgaagatccacatgctgcttcagctgctgtggaatggttcgataaacaggatttccatgggagcactattcaagttcacatagctgagccaaaaagcaaagatgcattcgataaccccacaagtttgaaacatcatggcggggggtg

SEQ ID NO: 37550 - DNA, 637 bp, Zea mays
  misc_feature: Ceres CLONE 1423646-F
  misc_feature (346)..(346): n is a, c, t, g, unknown, or other
  misc_feature (430)..(430): n is a, c, t, g, unknown, or other
aaagctggagctccccgcggtggcggccgctctagaactagtggatcccccgggctgcaggaattcgcaagagaccattacctagaacatcctaatcgaaaaaaaccaagagctccagttcctcttcctcacgcctctctgccaatccctcctccggccctctctccaggctccagcgccttctccggcgacgccggcatcgcccctagacgcggcccgaatctagggttcccctttcccgccgttggcggccggatcgcgcccagaggagcctccgcgatgctgccgtgcgcgaggtcggtgcttcggaggagggggctggcgtcttccctcctgcggatgtgcngcggggaggggccagtgctccacccgcacgggggagctggtcgccaatgccagtgtgcgagcacgctgggcgccctccgccgcngccggcccctgctccaaccccggcgccaggtgggcatatcccccaaaaccgccttgaattgggcccggggccgaatgggccccaccccccaaaccaggtggtttttcctccggttgccggccaaccgggaaagaagggggggggctttactccttccaagggtctacccaaaaaaaaaaggcctgttaaaaaggggggaaccccccc

SEQ ID NO: 37551 - DNA, 641 bp, Zea mays
  misc_feature: Ceres CLONE 1423660-F
  misc_feature: Encodes the peptide sequence at SEQ ID NO. 37552
aaagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacatacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagaccaaagaggtggcggctgtgaaggctaacgaagaggaaga

SEQ ID NO: 37552 - protein, 133 aa, Zea mays
  misc_feature: Ceres CLONE 1423660-F
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKEVAAVKANEEE

SEQ ID NO: 37553 - DNA, 692 bp, Zea mays
  misc_feature: Ceres CLONE 1423661-F
  misc_feature: Encodes the peptide sequence at SEQ ID NO. 37554
atagctggagctccccgcggtggcggccgctctagaactagtggatcccccgggctgcaggaattcgcacgagaccattacctagaacatcctaatcgaaaaatagcttgcagcgccacctacaccgagcagccaagcgaggaagcgaagacccatttccccgagcgcaagagtaccatggcggcggcggcagtttatggcggcctcaaggggaagcttggcgtcgaggatgcccccgagctgcagctgaatcgcatccgcatcaccctctcatccaagaacgtcaagaacctggagaaagtttgtgcggatttggtaaagggagccaaggataagcatctgagggttaaggggcctgttaggatccctactcacgttctggggggggggggccgaaaatccccttgccgtgaaggaaccaacacctgggaccggtttgacttccccctcccctaagagggggggatcgacctgaatcagctcccccccatgtggttgagccgaatcacctcccatccccactcgactccgggtggttgcgggtcccagtggccccccttgcctgactgtgtaacagcacctctccacattttcccccgggtgcgcttgccggccttctgggccccaccctccggccggtgccctggctagaaaaatacccaccccctcctttttgggcttcgccctttatc

SEQ ID NO: 37554 - protein, 92 aa, Zea mays
  misc_feature: Ceres CLONE 1423661-F
  misc_feature (26)..(93): Pfam Name: Ribosomal_S10 Pfam Description: Ribosomal protein S10p/S20e
MAAAAVYGGLKGKLGVEDAPELQLNRIRITLSSKNVKNLEKVCADLVKGAKDKHLRVKGPVRIPTHVLGGGGRKSPCREGTNTWDRFDFPLP

SEQ ID NO: 37555 - DNA, 652 bp, Zea mays
  misc_feature: Ceres CLONE 1423666-F
  misc_feature: Encodes the peptide sequence at SEQ ID NO. 37556
aaactggagctccccgcggtggcggccgctctagaactagtggatcccccgggctgcaggaattcgcacgagaccattacctagaacatcctaatcgaaaaaaaagcacgcgagcagcttcccttgcacgcctccctctcctctcgtccatccgttcctcccttcccctgcttcccggctctccctcccccccatccctgcacgccccttttcatgcgcgaggaggggccgtggggaccaccaccagcacctccatccgcgcgcatctcgcggtggtgctcctcctcctcctccccctgctcccggggcgggcgctctcctgttcctcctcctcctgctgctggtgccagggccgggagggcggcgcggaggtggcgctcatggggctcgccggggacgggtcggcggacaccgcccacctcagtaatagtgaaaatggtcggttcagttatggagttgcaagttctcccgggaaaagagcatcgatggaggacttctatgaggcaaggatagacgacgttgaccgagagaaagttggaatgttttggtgtgtatgatggtcatgggaagagtcagaacagctgagtacgtttagcagcatccttttcagcattttaatccaacacccaaaggttcatcactgataccaaag

SEQ ID NO: 37556 - protein, 58 aa, Zea mays
  misc_feature: Ceres CLONE 1423666-F
MGLAGDGSADTAHLSNSENGRFSYGVASSPGKRASMEDFYEARIDDVDREKVGMFWCV

SEQ ID NO: 37557 - DNA, 636 bp, Zea mays
  misc_feature: Ceres CLONE 1423677-F
  misc_feature: Translation starting site: 237
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagaggacaaggtggtgtacggcaccgcggacctcgggcggccgtgcgcgccgttcgccaagaacgcgtcggagatgcacggcttcacgcagggctgcctgaccctgcgcaggtgggacgagctcaacgccttcttccagaan

SEQ ID NO: 37558 - DNA, 811 bp, Zea mays
  misc_feature: Ceres CLONE 1423684-F
  misc_feature (38)..(38): n is a, c, t, g, unknown, or other
  misc_feature (39)..(39): n is a, c, t, g, unknown, or other
  misc_feature (96)..(96): n is a, c, t, g, unknown, or other
  misc_feature (97)..(97): n is a, c, t, g, unknown, or other
gggcgagccccccccccccccgacccgaggagcggaannctcccccccgcggggaaaagtcagagctggcactccaccgtcgggggcggccttccnnatacataagagggggggccggggttttccgttttcgccacgagagcgttgccaagaacatcctaaacgagaaacctcccacattaatgcgccgctctctcacctatcccctttcgtctcgatctcggagtaggacactccgcccgcttccggcttaaccttcaagattctccctcctcctcctacttctgcccgcttgggcgggcgcggcaccttccggttctgggcctcctatatatatacgcgcgtgaaccgtcccccttccatactccctagcatgctcggctcgcaccccggattgatcaaactcgcccgtcgccacaatggattcggagtcttccccctcctatttcaccccggccaccgttgactcccagtacccggcttgccgcttttgacgagctggcgaaggggcgtggagccagggcaagcacggctgccgcgcgagaggagcctcaaagggaaggagggccccgggcacggatgcaccaccctgagccctcacccccggccaatgggcaccgccgccggctggtaatcttctctttaggctcctcccatgcggggggaattccccaacagaaaaggggaccatagtacccccccggcgcctacgtgaacctggatcctaacccccccggcgggcaggacatttccccagagctgagggctggggagaattccctgtgtactttgaggatgctacgcgacccca

SEQ ID NO: 37559 - DNA, 729 bp, Zea mays
  misc_feature: Ceres CLONE 1423685-F
  misc_feature: Encodes the peptide sequence at SEQ ID NO. 37560
aagctggagctccccgcggtggcggccgctctagaactagtggatcccccgggctgcaggaattcgcacgagaccattacctagaacatcctaatcgaaaaaaaaaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaggaagaagtttgacgatgaaatccgtaacgataactggggatatt

SEQ ID NO: 37560 - protein, 170 aa, Zea mays
  misc_feature: Ceres CLONE 1423685-F
  misc_feature (12)..(165): Pfam Name: Mt_ATP-synt_D Pfam Description: ATP synthase D chain, mitochondrial (ATP5H)
MSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYKPKFDAVIAELKEAEKEHQKESERIEKELAEMEEMRKKISTMTADDYFEKYPELRKKFDDEIRNDNWGY

SEQ ID NO: 37561 - DNA, 709 bp, Zea mays
  misc_feature: Ceres CLONE 1423691-F
  misc_feature: Encodes the peptide sequence at SEQ ID NO. 37562
  misc_feature (521)..(521): n is a, c, t, g, unknown, or other
  misc_feature (535)..(535): n is a, c, t, g, unknown, or other
  misc_feature (539)..(539): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggccgaggcccccgcgtacctgcaccgcgacgacttcgcgcggtacctggacgggtacgccgcgcggttcgccgtccgcccgcgcctcccgcgcgaggtccggtcggcgncgtacaaccccccnagcncncnngtggaggtggaagccctgaacctcggcacgggccaggccgagcggtacgcggcgaggttcctggtggtcgcgtccggggagaacccgaagagtttcttgcggaagtgctgggctggaagcctcccccggccagtgatgcacccagtgaagtacgggtcggccgag

SEQ ID NO: 37562 - protein, 169 aa, Zea mays
  misc_feature: Ceres CLONE 1423691-F
  misc_feature (107)..(107): Xaa is any aa, unknown, or other
  misc_feature (113)..(113): Xaa is any aa, unknown, or other
  misc_feature (114)..(114): Xaa is any aa, unknown, or other
MAAVAEEEVIVVGAGQSGLAVAACLSLRGVRALVLERDDCVGSLWRKRAYDRLHLHLTKKYCALPHAPHPAEAPAYLHRDDFARYLDGYAARFAVRPRLPREVRSAXYNPPSXXVEVEALNLGTGQAERYAARFLVVASGENPKSFLRKCWAGSLPRPVMHPVKYGSAE

SEQ ID NO: 37563 - DNA, 858 bp, Zea mays
  misc_feature: Ceres CLONE 1423692-F
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
ggcgcccccctcccccctcctgtggccgggnnnnnnntaaannannaaaaactggagctccccccggtggcggccgctctagtattagtggatcccccgggctgcaggaatttgcacgagaccattacctagaacatcctaatcgaaaatcccactaaaaagggccagggccagggccttcgcttgcttactactcctgcttacgacctctacatggtgtcttcgggtgcctccgacacctccccccatgcatgcggtggaagaggaggaggtgatcttttgtcggggcgggggaattcgggggctagcggaggacggggggcttgccctagctgggggtgggggcgctgggttcgggactgggacgactgcgtggggtttctaggggggtaaggcagcctagggaggggtgatcctttcacctcctcttgaaattcttagggggtgggcggccgggggcggatccggggggaggcgcccccccccaccctagtccgcgcgccagacatgggggtgtaaactttgcctgggtggcggccaaggggtgtcgtgcgtgtggtcgtccacacccggcacgctatgttccagggtcgcgcgtgggaagctagattgggaaaacctcggcacatgctgcccgacgaaggcggtgggatccttttctgcggcggttcggcgcgcggtcggggcagcgcgtggtaggtgccctgtcttgctccgtcgcgctgggggaacggtgtgatagaggccccgggacgcgggcggccagtgggctgagccgaccggtgcgcccgcgtccgtgcgtcgcctagtgtcggctcctaccgccgcgctgtcgctcgtggggctacgacttcgcgc

SEQ ID NO: 37564 - DNA, 744 bp, Zea mays
  misc_feature: Ceres CLONE 1423693-F
  misc_feature: Encodes the peptide sequence at SEQ ID NO. 37565
aagctggagctccccgcggtggcggccgctctagaactagtggatcccccgggctgcaggaattcgcacgagaccattacctagaacatcctaatcgaaaaatatacctcctcaaggcacgttcaccacagtcctctctttccccggcaccaccaccaccacccaggctaacaggactggaccgagtgttgaacaacactgcagtgagcgacggcaggcatggtgagccgtgaaaatttgcacctggtgctggacccggcgtctctgggcgcgccttgggccgacccgtccgccgcagagatcccgccgcagctcctcgccgcgctgggagagtacctctcctccgcccgcggcgacgtcgagaccgaggcggacgacgagttcatgatgcacgacttcaaggtgcggcggtgcgcgcgcgcgcagagccacgactggacggcgtgcccctacgcgcacccgggggaggccgcgcggcagcgggacccgcgccgcgtggcctacgcgggggagccgtgcccggacttccggcgccccccgggcccgggcgccgcgtgcccgctcggggccgcctgcccgctcgagcactgtaccttcgagctgtggctccaaccgtcccgctaccgcatgcgccccttgacgcgccggcgctgcatgggccccgccgcgttctgcttccttctctgaagcccgcgtgccgaaactctcgcgcccgtgcgcccgcccccctccaaagtgacaggt

SEQ ID NO: 37565 - protein, 155 aa, Zea mays
  misc_feature: Ceres CLONE 1423693-F
MVSRENLHLVLDPASLGAPWADPSAAEIPPQLLAALGEYLSSARGDVETEADDEFMMHDFKVRRCARAQSHDWTACPYAHPGEAARQRDPRRVAYAGEPCPDFRRPPGPGAACPLGAACPLEHCTFELWLQPSRYRMRPLTRRRCMGPAAFCFLL

SEQ ID NO: 37566 - DNA, 743 bp, Zea mays
  misc_feature: Ceres CLONE 1423695-F
  misc_feature (401)..(401): n is a, c, t, g, unknown, or other
  misc_feature (409)..(409): n is a, c, t, g, unknown, or other
  misc_feature (410)..(410): n is a, c, t, g, unknown, or other
aaagctggagctccccgcggtggcggccgctctagaactagtggatcccccgggctgcaggaattcgcacgagaccattacctagaacatcctaatcgaaaaagatggctgaagagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgacatcagcccctcgcccgctcgccgagacaccgagtcggcatcgaccgtcgtcgcgtctccgaagtccagcgcctagtggcccagctccaagcctcccagcatcggcgcccgnccctcctnncgcgagacgcccaagtgccgaagcgcccgagcaaccccgtcccccagcgccccaacaagctaacaggcctgcaagaatgcccctctttggttaatccctccaaaggatttgagcttgaatgcccccaaaaggtaacagggcttccaaaaactaaagggaaaggcgcgcttttcggaacacccggaaaagattccttttttaaaaagggccaaccgggggcgcgtttgggggaatttcaaaaacccaccccccgaaaaataaaaattcttggaaaaagaaccctccctttgtgaaaaaaaaaaaaaggggggtatttccccttaaggggcccaa

SEQ ID NO: 37567 - DNA, 665 bp, Zea mays
  misc_feature: Ceres CLONE 1423698-F
  misc_feature: Encodes the peptide sequence at SEQ ID NO. 37568
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaaatcataaaaaaaagacaccctgcgtcatttaccgaccaccgtccatccatggatgcagccgagggccgaggggcagagtgggccgaggggcgtggcaggcggtgagcacgccggtggtcgggacggtacggatctcgtgatccatggccttcgcgggatggcgctgctccctgcttatgacacctcccgttcaccggcagcgaatcggggcttggcatttcccatcaagcattaagcagtgaagcaccccccctcgtttccaccggcagtccggcagcgagcagacagtaacagaatcaggcggtgtcttggaaataacttcagtgccatggcctggtctcatggaacatctccattatttccagtttacaagcttgagcagatcctgatgcgaggaccctccatctgtgatactctcgcacgctgctctncttcaagaaagtgcctcgctctgatcgatcatcagcgagcagctgggtgacttgtccctgatctctccttgggaagacgcccgctcgtggcaccgatcctcagccgtgccccaacgtcgagatgtcttctgt

SEQ ID NO: 37568 - protein, 50 aa, Zea mays
  misc_feature: Ceres CLONE 1423698-F
  misc_feature (35)..(35): Xaa is any aa, unknown, or other
MAWSHGTSPLFPVYKLEQILMRGPSICDTLARCSXSRKCLALIDHQRAAG

SEQ ID NO: 37569 - DNA, 643 bp, Zea mays
  misc_feature: Ceres CLONE 1423713-F
  misc_feature: Encodes the peptide sequence at SEQ ID NO. 37570
aaagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctcctctgcctcgaggagttccgcggcctgctcttcggctccggggactcgcccgctgcttcggccccgctcgaccgcctcgtcgccgacttctccgacgcgccctcaaggggctcgacctctgcac

SEQ ID NO: 37570 - protein, 121 aa, Zea mays
  misc_feature: Ceres CLONE 1423713-F
MPATDSSSSSSSSPAAAPLSSIGRSIRSLRRDQNQIHSFPPPPDATDAFQRRAAQLLADLPAADDVLSLAWTRRLLESFLLCLEEFRGLLFGSGDSPAASAPLDRLVADFSDAPSRGSTSA

SEQ ID NO: 37571 - DNA, 649 bp, Zea mays
  misc_feature: Ceres CLONE 1423718-F
  misc_feature: Encodes the peptide sequence at SEQ ID NO. 37572
ctggagctccccgcggtggcggccgctctagaactagtggatcccccgggctgcaggaattcgcacgagaccattacctagaacatcctaatcgaaaacacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaggctctgcacaagaaccttgctgccagagaattgctataccaacaccagcataacaaaaggatgagctgccctgccatggcacagctcctctccaataccctgtactacaagcgcttcttcccatattacgccttcaatgtgctcggtgggcttgacagcgaggggaaagggtgtgttttcacctatgatgcagtaggtcctaccaggagactggttatagtgctcaaggaactggatctactttgattatgccagtcctggaccatcaactaaaaacaca

SEQ ID NO: 37572 - protein, 147 aa, Zea mays
  misc_feature: Ceres CLONE 1423718-F
  misc_feature (10)..(144): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGPTRRLVIVLKELDLL

SEQ ID NO: 37573 - DNA, 691 bp, Zea mays
  misc_feature: Ceres CLONE 1423723-F
  misc_feature: Encodes the peptide sequence at SEQ ID NO. 37574
  misc_feature (435)..(435): n is a, c, t, g, unknown, or other
  misc_feature (459)..(459): n is a, c, t, g, unknown, or other
  misc_feature (474)..(474): n is a, c, t, g, unknown, or other
aagctggagctccccgcggtggcggccgctctagaactagtggatcccccgggctgcaggaattcgcacgagaccattacctagaacatcctaatcgaaaatatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctgggcgcggcgccctactacgccggggtgtggcagccgaagcgcatgtttcagccgctcccgcaacagtgctgccagcancagatgaggatgatggacgtgcantccgtcccgcaacanctgcaaatgatgatgcacctggagcgtggccgctgccgccagcaacaagcttgtacaaaccagtttttgattcaccaacaacaacaacttggtgggaaccccaggtcctcaaccccctggccccttaattagtggcccaaaaaattccccgcccctgggggggaattttaccagaaaccaggtgtccccaatttaccccacccaaccccccgggggg

SEQ ID NO: 37574 - protein, 146 aa, Zea mays
  misc_feature: Ceres CLONE 1423723-F
  misc_feature (90)..(90): Xaa is any aa, unknown, or other
  misc_feature (98)..(98): Xaa is any aa, unknown, or other
  misc_feature (103)..(103): Xaa is any aa, unknown, or other
MKMVIVLVVCLALSAASASAMQMPCPCAGLQGLYGAGAGLTTMMGAGGLYPYAEYLRQPQCSPLGAAPYYAGVWQPKRMFQPLPQQCCQXQMRMMDVXSVPQXLQMMMHLERGRCRQQQACTNQFLIHQQQQLGGNPRSSTPWPLN

SEQ ID NO: 37575 - DNA, 656 bp, Zea mays
  misc_feature: Ceres CLONE 1423734-F
  misc_feature: Encodes the peptide sequence at SEQ ID NO. 37576
agctccccgcggtggcggccgctctagaactagtggatcccccgggctgcaggaattcgcacgagaccattacctagaacatcctaatcgaaaactctgctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatccctcaggcccatgggttggcgccgagatccgggagactctacttctcattagaaagcggtggcaattaggagcctttgaaaagaacaggaagacaggactcccattccaacccttcttgttaaagaagaacaccgccctggccgctaatacaaggtacaagaaactcccccccccccggaaataaagaacaactcggggagaccttggggggcccaaaagaaaacccccccagg

SEQ ID NO: 37576 - protein, 96 aa, Zea mays
  misc_feature: Ceres CLONE 1423734-F
  misc_feature (1)..(60): Pfam Name: Ribosomal_S13_N Pfam Description: Ribosomal S13/S15 N-terminal domain
MGRMHSRGKGISSSALPYKRTPPIWLKTATTEVEEMITKAAKKGQMPSQIGVLLRDQHGIPLVKSVTGSKILRIPQAHGLAPRSGRLYFSLESGGN

SEQ ID NO: 37577 - DNA, 727 bp, Zea mays
  misc_feature: Ceres CLONE 1423736-F
  misc_feature: Encodes the peptide sequence at SEQ ID NO. 37578
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgcaccgtcgcagcttccgctggcagcagctgcagctcccaaccgtgccgcggcagcgagctcgcgctgac

SEQ ID NO: 37578 - protein, 108 aa, Zea mays; identical to SEQ ID NO: 16131
  misc_feature: Ceres CLONE 1423736-F

SEQ ID NO: 37579 - DNA, 723 bp, Zea mays
  misc_feature: Ceres CLONE 1423739-F
  misc_feature: Encodes the peptide sequence at SEQ ID NO. 37580
aagctggagctccccgcggtggcggccgctctagaactagtggatcccccgggctgcaggaattcgcacgagaccattacctagaacatcctaatcgaaaacacacggatcgaaaacgaattaccctcggtgccctccctctcggcggcggcggcgcaagtccccttcatctccggcgcggcaaatggcaggtggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcagcgtcgtcgtcgaagagtagttcccacgtgtcacctcagaagttttttttttccagttgtttttgaaaactcactctggaaggcacgacaaagtgaaatgctgtgaagatttggcttgaaattagcataaccatttgaaaccaccagcttctgttgaattgcttttcctggcatgactatttgagcatgtccgggtcgaaaccaaaaaaaaaaaaaaaagcttatcgatccctccaactcgaaggggggcccggggacccaattccccctaaaggggggccaaaaaccccccccccctgggccccttttaaacaaacccgggagggaaaaacccgggggtccccaatattaccccctggaaaaaccc

SEQ ID NO: 37580 - protein, 63 aa, Zea mays
  misc_feature: Ceres CLONE 1423739-F
  misc_feature (2)..(63): Pfam Name: COX5C Pfam Description: Cytochrome c oxidase subunit Vc (COX5C)
  misc_feature: SWISSPROT Homolog: EC 1.9.3.1 Cytochrome-c oxidase
MAGGRVAHATLKGPSVVKEIFIGLTLGLIAGGMWKMHHWNEQRKTRSFYDMLDKGQISVVVEE

SEQ ID NO: 37581 - DNA, 710 bp, Zea mays
  misc_feature: Ceres CLONE 1423749-F
  misc_feature: Translation starting site: 309
  misc_feature (279)..(279): n is a, c, t, g, unknown, or other
  misc_feature (443)..(443): n is a, c, t, g, unknown, or other
  misc_feature (452)..(452): n is a, c, t, g, unknown, or other
  misc_feature (457)..(457): n is a, c, t, g, unknown, or other
  misc_feature (478)..(478): n is a, c, t, g, unknown, or other
  misc_feature (485)..(485): n is a, c, t, g, unknown, or other
aagctggagctccccgcggtggcggccgctctagaactagtggatcccccgggctgcaggaattcgcacgagaccattacctagaacatcctaatcgaaaaagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatcaggcgcnttagaaggcgcgctggccggtggatgacgatggcgggtggcgggggactgaaccggtcttcatcgagggggcagctgccgccgcaagagctgcttgacgatctctgcagccggtttctttctgatgtgcccaaggagagctggagtcgttcgagcggatcctgntcctgctgnagcangcccactggttctatgagacnactccgntgagcacaacccccacctcagtccttcttcttcaggacttcactttcctcatgttcagaattgcattgttttcgggccctaatttgggcacctggtgaatttctcaaggactttcacaactcacaaatttctgtggccttgttccggccccctttccctaaaaaaaactttttaaagggctttttcttttaaaagggaaaaagggtggggccacttggaattttc

SEQ ID NO: 37582 - DNA, 715 bp, Zea mays
  misc_feature: Ceres CLONE 1423753-F
  misc_feature: Encodes the peptide sequence at SEQ ID NO. 37583
ctggagctccccgcggtggcggccgctctagaactagtggatcccccgggctgcaggaattcgcacgagaccattacctagaacatcctaatcgaaaaacaacaaaacaagcctaatggcttcctctccatctcacgccactgcgttgcctacttgccctagaaccctcgccgccgcccctctttaggattcccatgtccctggtcgccccctgacacgcccgccccggatcctgcaccggaattccgcgtggaattccgggccgaaccgcctctctgcgtgcgcctccgaccaccaaactctctctctcacacgcgcgcgcgcgcgcacgtctgaggcggttggattctccggtgggggttccttggtctcgatttgctgctgatgggggtgccgaagcagcgctggacgccggaggaagaggccgcgctcaaggccggcgtcgccaagcacgggcccggcaagtggcgcaccatcctccgggactcggacttcagcgcgctcctgcgcctccgctccaatgttgacctcaaggtgacgctcggatcgccggggagggcggtcggtgggtttttggcgatcagctgggggagtacggaggaaatctccagtctttttagtagcgaaagaaaattgcggttttggacggtccatacagcttggtgtgttccttatttggttctagatcgggattttaggtggttggtagaaggaa

SEQ ID NO: 37583 - protein, 110 aa, Zea mays
  misc_feature: Ceres CLONE 1423753-F
MGVPKQRWTPEEEAALKAGVAKHGPGKWRTILRDSDFSALLRLRSNVDLKVTLGSPGRAVGGFLAISWGSTEEISSLFSSERKLRFWTVHTAWCVPYLVLDRDFRWLVEG

SEQ ID NO: 37584 - DNA, 678 bp, Zea mays
  misc_feature: Ceres CLONE 1423754-F
  misc_feature (349)..(349): n is a, c, t, g, unknown, or other
tggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaacggcgtggcatgaatcacgagagagatagcaggctggctagctagctgagctcgtgcgacgaacactggccgtaantggcagaaacatgtggcacccctcctggtgctcaacctcatcatgtacatcactctcatcgggctcccggagctgggaaccttgacccatttcgtcaccggggaaaaccaattaccccggggtggcccgggacgggcgcaacctttctaattccggggggtccccaaacctggccccggtttgttgggcccgaatttcaaaaaaattgggggtgtgcacccaaagtgccccccctttgtggccccccaaaaaattttggaaaaaaaaaaaccccgcggttttttttttttattttttggggggggagaaaacaaaggggggggggcccc

SEQ ID NO: 37585 - DNA, 741 bp, Zea mays
  misc_feature: Ceres CLONE 1423755-F
  misc_feature: Encodes the peptide sequence at SEQ ID NO. 37586
  misc_feature (741)..(741): n is a, c, t, g, unknown, or other
aagctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaaggacccactttgccatgagagtcaacagtttcttgcgtcagctacgcactcatcctactcttaataagtttgttataaagttcgggctgcgcaggaggcacactcggccctgtcaacagatggatccgctcctgctccgggtccgcgagcaaaacccatccactataatttccactcgtgggagggaaan

SEQ ID NO: 37586 - protein, 162 aa, Zea mays
  misc_feature: Ceres CLONE 1423755-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTHFAMRVNSFLRQLRTHPTLNKFVIKFGLRRRHTRPCQQMDPLLLRVREQNPSTIISTRGRE

SEQ ID NO: 37587 - DNA, 646 bp, Zea mays
  misc_feature: Ceres CLONE 1423758-F
aagctggagctccccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagacgaagagcctgctgttggcgctcagcgtggcggcgctgctcgcggcgcagtcggactcccacggcctgggggacttcacgagcgggagcggcgaggcgaacgacgacgccggagatgcagaccttcttcaagccccaggccgctgcggcgctcccggaggccctcgacgcctccatgcccgccaaacccgaagcggggggcggcgcgctccccggcacaaaaagggccgcacggcgccgttagccacgccccgcaaggcccttgtccctggccccccggctggccctgccgcctgggcgccctgggcctgggccggcattccttcccccccgggggatacctgggtgcgcgggccccccggcccgggaaaaaaaaggaaaatctctggcccccccccccggggaccccccccccggggggggg

SEQ ID NO: 37588 - DNA, 624 bp, Zea mays
  misc_feature: Ceres CLONE 1423760-F
  misc_feature: Encodes the peptide sequence at SEQ ID NO. 37589
  misc_feature (175)..(175): n is a, c, t, g, unknown, or other
  misc_feature (396)..(396): n is a, c, t, g, unknown, or other
ctccccgcggtggcggccgctctagaactagtggatcccccgggctgcaggaattcgcacgagaccattacctagaacatcctaatcgaaaactctccagtctccagcctccatcagtccaggtcgatcgcgatcggaggccagaaatccatggccgctcccgccgccgcgccgnctcgacgaagggcaagggcgaagaaagtccttcgccaggtcgagttctacttcagcgacagcaacctcccccgcgataagttcctgcgggagacggtcgagcagagcgatgacggattggtgagcttgcccttgatatgctccttctcgcggatgaagtcccacctggggctggacgcagatgtcaagcccgagactgtgccggaggagaccgtgcttgcngttgctgaggtgctccggccttctcctgccctccgcgtatcggaagatggaaagaagattggtagagctagtgaactcttggagcccgatgagatcatagaaacagtagactctagggacttttgctgtttctccccctgccttgcaatggaaaagcaggaagaacctccaatcttttttttccaaatttttgcaaaaggtaaaataccctggagacttccccgccca

SEQ ID NO: 37589 - protein, 158 aa, Zea mays
  misc_feature: Ceres CLONE 1423760-F
  misc_feature (18)..(90): Pfam Name: La Pfam Description: La domain
  misc_feature (9)..(9): Xaa is any aa, unknown, or other
MAAPAAAPXRRRARAKKVLRQVEFYFSDSNLPRDKFLRETVEQSDDGLVSLPLICSFSRMKSHLGLDADVKPETVPEETVLAVAEVLRPSPALRVSEDGKKIGRASELLEPDEIIETVDSRDFCCFSPCLAMEKQEEPPIFFFQIFAKGKIPWRLPRP

SEQ ID NO: 37590 - DNA, 642 bp, Zea mays
  misc_feature: Ceres CLONE 1423762-F
  misc_feature: Encodes the peptide sequence at SEQ ID NO. 37591
aaagctggagctccccgcggtggcggccgctctagaactagtggatcccccgggctgcaggaattcgcacgagaccattacctagagcatcctaatcgaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccgggcccctcaccaacaagattgctccccggcccccccccaaagggtttttttaaaaacaaaaaaatccccgacaacacaacgggggggggggtttttttttttttttggggcgggggcggcggcccccgccccccccgg

SEQ ID NO: 37591 - protein, 85 aa, Zea mays
  misc_feature: Ceres CLONE 1423762-F
  misc_feature: SWISSPROT Homolog: EC 1.6.5.3 NADH dehydrogenase (ubiquinone)
MSKTAEFVVSKVDDLMNWARKGSIWPMTFGLACCAVEMMHAGASRYDFDRFGVIFRPSPRQSDCMIVAGPLTNKIAPRPPPKGFF

SEQ ID NO: 37592 - DNA, 628 bp, Zea mays
  misc_feature: Ceres CLONE 1423765-F
  misc_feature: Encodes the peptide sequence at SEQ ID NO. 37593
  misc_feature (436)..(436): n is a, c, t, g, unknown, or other
  misc_feature (498)..(498): n is a, c, t, g, unknown, or other
aagctggagctccccgcggtggcggccgctctagaactagtggatcccccgggctgcaggaattcgcacgagaccattacctagaacatcctaatcgaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctccccaccccgccctacgacctgacgtccttccggttcagccccatcaaggagtccatcgtgtcccgcgagatgacccngcgctacatgacggacatgatcacccacgccgacaccgacgtggtgatcgtgggcgccgggntcgcgggcctgtcctgcgcgtacgagctgttaagggacccctccgtgagcgtcggcatcgtggagcaattcgtggtcccccgggcggcgccccctgggcttgggcggggaactttttttctcggcccatg

SEQ ID NO: 37593 - protein, 208 aa, Zea mays
  misc_feature: Ceres CLONE 1423765-F
  misc_feature (145)..(145): Xaa is any aa, unknown, or other
  misc_feature (166)..(166): Xaa is any aa, unknown, or other
AGAPRGGGRSRTSGSPGLQEFARDHYLEHPNRKIPSPQASVVSPSHTHYTLLCCSKKEEASASLALVVSNGHHRRVQPPQVLLRGLPAPFGHAHHHPVVRGRGHPARRRRPHPRVHLLLPTPPYDLTSFRFSPIKESIVSREMTXRYMTDMITHADTDVVIVGAGXAGLSCAYELLRDPSVSVGIVEQFVVPRAAPPGLGRGTFFLGP

SEQ ID NO: 37594 - DNA, 650 bp, Zea mays
  misc_feature: Ceres CLONE 1423771-F
  misc_feature: Encodes the peptide sequence at SEQ ID NO. 37595
  misc_feature (453)..(453): n is a, c, t, g, unknown, or other
  misc_feature (509)..(509): n is a, c, t, g, unknown, or other
tggagctccccgcggtggcggccgctctagaactagtggatcccccgggctgcaggaattcgcacgagaccattacctagaacatcctaatcgaaaaaaaaaggaaagctctctcattgccaaattgcccccgactcaagccccccgcgccgccggcgttggtggaatcgatcgacccggcctcgccggacaatccaccagcgttggtttcacctcaggtttttgtgcatggaagatgacaatgaggtcactggagagtcacctgtggctgatgaatgggatatgttgtccctgacttcatcaatatatgctagcccattattccgaagaggatttgatccaattaatttgcctggatatgggaatgtgattaatattcaggaaggcacacaaactggattagtcatgtcagatggcttcgtgttcccctccagtgagcatgaaaatttgccnatagaaccagagcatgaggatttgcccatagaaccagggcatgatgaatcaaatancaacagcgttgaaaaagaaagtagttgtgctggaaataaccatgatgactggtgtcatgtttcacctggagaaatccatgacgttagttattgaaatctagctgacaacagtgacctggctactggccgtgaagctaccgt

SEQ ID NO: 37595 - protein, 124 aa, Zea mays
  misc_feature: Ceres CLONE 1423771-F
  misc_feature (94)..(94): Xaa is any aa, unknown, or other
MEDDNEVTGESPVADEWDMLSLTSSIYASPLFRRGFDPINLPGYGNVINIQEGTQTGLVMSDGFVFPSSEHENLPIEPEHEDLPIEPGHDESNXNSVEKESSCAGNNHDDWCHVSPGEIHDVSY

SEQ ID NO: 37596 - DNA, 654 bp, Zea mays
  misc_feature: Ceres CLONE 1423772-F
  misc_feature: Encodes the peptide sequence at SEQ ID NO. 37597
  misc_feature (376)..(376): n is a, c, t, g, unknown, or other
  misc_feature (427)..(427): n is a, c, t, g, unknown, or other
  misc_feature (494)..(494): n is a, c, t, g, unknown, or other
  misc_feature (603)..(603): n is a, c, t, g, unknown, or other
aaagctggaactccccgcggtggcggccgctctagaactagtggatcccccgggctgcaggaattcgcacgagaccattacctagaacatcctaatctaaaaaaaaaactagcgcttactgttttgcacggccatagtctcgatccccaccgagtccagcaaccagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgtcgcagcactatcacccgccctccacctccgacggcgacaatgaggtcnaaaaagacgagggaagcatggacgacggcagcgccaaagaggatgatgccnagctgtccgacggaggggctctcggctcgccgcggcgacgcgccttctccgctccaggtgaaccaangggttgcgcagaggctttcaggtattggacgtatggagataaatgggggaaaatgagtgaggtcaatccaagagggggcagcaatggcatttatgtaaccatggaatcnagattgggcgtccatcaccaggaaggggatgaacctggtaccatccccaga

SEQ ID NO: 37597 - protein, 149 aa, Zea mays
  misc_feature: Ceres CLONE 1423772-F
  misc_feature (57)..(57): Xaa is any aa, unknown, or other
  misc_feature (74)..(74): Xaa is any aa, unknown, or other
  misc_feature (96)..(96): Xaa is any aa, unknown, or other
MASPAGANSGASSSRGTPLPLPFPFPAAAHFPSRGAGPFLSQHYHPPSTSDGDNEVXKDEGSMDDGSAKEDDAXLSDGGALGSPRRRAFSAPGEPXGCAEAFRYWTYGDKWGKMSEVNPRGGSNGIYVTMESRLGVHHQEGDEPGTIPR

SEQ ID NO: 37598 - DNA, 628 bp, Zea mays
  misc_feature: Ceres CLONE 1423777-F
  misc_feature: Translation starting site: 260
  misc_feature (628)..(628): n is a, c, t, g, unknown, or other
aaagctggagctccccgcggtggcggccgctctagaactagtggatcccccgggctgcaggaattcgcacgagaccattacctagaacatcctaatcgaaaaatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaccatggtttcaccaatgatgatgccgagtatgaatcccttccacgatgaaccccaaaatttaatgccccccaaaaaggttccccattttgaaaccccccccataaaaaacccccaaaaatggggtgttan

SEQ ID NO: 37599 - DNA, 776 bp, Zea mays
  misc_feature: Ceres CLONE 1423779-F
  misc_feature: Encodes the peptide sequence at SEQ ID NO. 37600
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
actttcccatttttcgtctggcgctgccaccgggccacatccccccaaccataccccgccgcggagttgnnnaaacccctttttaaaactggggctccccgcggtggcggccgctctatatactagtggatcccccgggctgcaggaattcgcacgagaccattacctagaacatcctaatcgaaaagttttccaacacagcgaggcccacgttgtagggttttttgcttgcttcgcccggcggtaaagctgagcgcggcgagagccggagaccgaagaagcgccgcccgccgcgcgcccggtcatggagatcggacagtaccccgcgagcggctgctccaaggagcaccagaagatctaccaggagtggttcgcgctcgcggacgcagatggggatggccgcatcacgggccccgatgcgatcaagttttttggcatgtccaagctctcccgccctgacctcaagcaggtctgggctatcgcggacaccagaaggcaggggtatctgggtttctctgaattcgtcacgggcgatgcagcttagtctctctggcacaagtaggcaacgaagattactccaagatagcccttaagccgagaatgattttgaggcaggctggaatccaccctgtggatgggaagggtttgggatggcccttacctgggggaaattcctaaagccacttttggtggaaagcggggtttgatcccaagaaaagggggaggggattaatccctcaagggaaaacaaaccttccctttttaaacaaacacaa

SEQ ID NO: 37600 - protein, 79 aa, Zea mays
  misc_feature: Ceres CLONE 1423779-F
  misc_feature: SWISSPROT Homolog: EC 2.7.11.1 Non-specific serine/threonine protein kinase
MEIGQYPASGCSKEHQKIYQEWFALADADGDGRITGPDAIKFFGMSKLSRPDLKQVWAIADTRRQGYLGFSEFVTGDAA

SEQ ID NO: 37601 - DNA, 669 bp, Zea mays
  misc_feature: Ceres CLONE 1423781-F
  misc_feature: Encodes the peptide sequence at SEQ ID NO. 37602
ctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaaggaccaactttgccatgagagtcaacagtttcttgcgtcagctacgcactcatcctactcttaataagtttgttattaagttcgggctgcgcaggaagcacactcgccatgtcaacagatg

SEQ ID NO: 37602 - protein, 139 aa, Zea mays
  misc_feature: Ceres CLONE 1423781-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTNFAMRVNSFLRQLRTHPTLNKFVIKFGLRRKHTRHVNR

SEQ ID NO: 37603 - DNA, 722 bp, Zea mays
  misc_feature: Ceres CLONE 1423782-F
  misc_feature: Encodes the peptide sequence at SEQ ID NO. 37604
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (455)..(455): n is a, c, t, g, unknown, or other
ggtgggtagtgtagaggttggcccctctaaaagggtgnnnnngtgngggtagtnnntcatagctggactccccgcggtggcggccgctctttttctaaaggacccccgggctgcaggaatcccacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggccggcgcccgatgggtgagcaggtgaagggcatgctccacgacaaggggccgacggcgtcgcaggcgctgacggtggcgacgctgttcccgctgggcgggctgctgctggtgctgtcngggctggcgctgacggcctccgtggtggggctggccgtggccacaccggtgttcctgatcttcagccccgtgctggtccccgccgcgctgctcatcgggaagggcgtcaaggggggtccccacgtccgggcgcgcctgggggctcgggggggcctggtccccggctacaagggggcctccgacaaaacacggggggcggggaaggagggtctccagccggcaccccccgggaacttaaccttgggaagggaggggggcccccccgcg

SEQ ID NO: 37604 - protein, 154 aa, Zea mays
  misc_feature: Ceres CLONE 1423782-F
  misc_feature (44)..(154): Pfam Name: Oleosin Pfam Description: Oleosin
MADRDRSGIYGGAHATYGQQQQQGGGRRPMGEQVKGMLHDKGPTASQALTVATLFPLGGLLLVLSGLALTASVVGLAVATPVFLIFSPVLVPAALLIGKGVKGGPHVRARLGARGGLVPGYKGASDKTRGAGKEGLQPAPPGNLTLGREGGPPA

SEQ ID NO: 37605 - DNA, 635 bp, Zea mays
  misc_feature: Ceres CLONE 1423787-F
  misc_feature: Encodes the peptide sequence at SEQ ID NO. 37606
  misc_feature (587)..(587): n is a, c, t, g, unknown, or other
  misc_feature (635)..(635): n is a, c, t, g, unknown, or other
aagctggagctccccgcggtggcggccgctctagaactagtggatcccccgggctgcaggaattcgcacgagaccattacctagaacatcctaatcgaaaaagcaaaactagcggcgcagtgacaaaagcccacagcttcttccccctcctccttctccgtcatccgtttcgctctctgccgccgccaccgcacaagaagctagctcctgcctgtaccaccccggcatggcgatgctatcccgcgcagcctcctccgcggcccggcgcccgctgctgccgccgcctaggcttctggcggtgagggcgatggcgtcgtcgctcttcggccacgtcgagcaggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcatcaagatgattgaagagtcactgaagctggcgtacggagaagattctgacttcatcnaagataagaggatagcagcggtgcaggcgctttcaggcactggtgccn

SEQ ID NO: 37606 - protein, 136 aa, Zea mays
  misc_feature: Ceres CLONE 1423787-F
  misc_feature: SWISSPROT Homolog: EC 2.6.1.1 Aspartate transaminase
  misc_feature (121)..(121): Xaa is any aa, unknown, or other
MAMLSRAASSAARRPLLPPPRLLAVRAMASSLFGHVEQAPKDPILGVTEAFLADPSSDKVNVGVGAYRDDNGQPVVLSCVREAERRIAGNLNMEYLPMGGSIKMIEESLKLAYGEDSDFIXDKRIAAVQALSGTGA

SEQ ID NO: 37607 - DNA, 642 bp, Zea mays
  misc_feature: Ceres CLONE 1423788-F
  misc_feature: Encodes the peptide sequence at SEQ ID NO. 37608
aaagctggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacgacgaggtgtcgcgcatgatggaagaggcggacgccgacggcgaccgctgcatcagcctgcccgaattcgcccccgctcatggagtccgccttccgccaaccccccgccgttcaaggaagaccttgcccacgc

SEQ ID NO: 37608 - protein, 134 aa, Zea mays
  misc_feature: Ceres CLONE 1423788-F
  misc_feature (56)..(84): Pfam Name: efhand Pfam Description: EF hand
  misc_feature: SWISSPROT Homolog: EC 2.7.11.1 Non-specific serine/threonine protein kinase
MGKVRSFFSRSRSGKRGSARRAGSSSPHSSAASAPPSPSPLPRRSPSSSSTTTRDETERVFRKFDANGDGQISRSELAALFEGVGHAVTDDEVSRMMEEADADGDRCISLPEFAPAHGVRLPPTPRRSRKTLPT

SEQ ID NO: 37609 - DNA, 668 bp, Zea mays
  misc_feature: Ceres CLONE 1423792-F
  misc_feature: Encodes the peptide sequence at SEQ ID NO. 37610
aaagctggagctccccgcggtggcggccgctctagaactagtggatcccccgggctgcaggaattcgcacgagaccattacctagaacatcctaatcgaaaagcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcaccacaactaacacaacttgtgctaacaaaacttgctgcctactctcagcaaacacagttttcttcatttccaccactagctgcattgaaactcctgctttcttatttgcacaaacaccttctaccctttcagcccgcctaccgggtgggctacccccccaaaaatttcttcccattttcaaccacccgggtagccatttaaacccctcccggccttatttaacc

SEQ ID NO: 37610 - protein, 162 aa, Zea mays
  misc_feature: Ceres CLONE 1423792-F
MAAKIFCLLMLLGLSASAATATIFPQCSQAPIASLLPPYLSPAVSSVCENPILQPYRIQQAITAGILPLSPLFLQQSSALLHQLPLVHLLAQNIRAPQLTQLVLTKLAAYSQQTQFSSFPPLAALKLLLSYLHKHLLPFQPAYRVGYPPKNFFPFSTTRVAI

SEQ ID NO: 37611 - DNA, 814 bp, Zea mays
  misc_feature: Ceres CLONE 1423804-F
  misc_feature: Encodes the peptide sequence at SEQ ID NO. 37612
  misc_feature (1)..(1): n is a, c, t, g, unknown, or other
  misc_feature (2)..(2): n is a, c, t, g, unknown, or other
  misc_feature (78)..(78): n is a, c, t, g, unknown, or other
  misc_feature (81)..(81): n is a, c, t, g, unknown, or other
nnttctcggtgtcgcgcgtggggtctccaccgcggccaatcccttcacccccccccctcctctttaggtgttccccanaangggtataaagctggagctccccgcggtggcggccgctctagaactagtggatcccccgggctgcaggaattcgcacgagaccattacctagaacatcctaatcgaaaaatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaaccaggcaatcgcagcaggcatcttaccttttatcaccccttgttccctccaacaaccggtcagcccctaattacaagcagttaccttttgggggcattttgttgggcaccaaaaccatctaaggtaccaacaaacttacaaccaactttggtggcttaaggaaaaacccttggctggccctaacttcctccaggcaaacaggcagttttcccttcacatttccaaccccaacttggggctggcaattggaaactcctggcgtgctttaatttgggcaacaaaccaaccttcccactttcccgtccccggctaaggttggcttggccctacccccccgagcaaattttctcttcccttttccaaaccaagcttgggcaaggccattggcaaaccccttg

SEQ ID NO: 37612 - protein, 111 aa, Zea mays
  misc_feature: Ceres CLONE 1423804-F
MAAKIFCFLMLLGLSASAATATIFPQCSQAPIASFLPPYLSPAVSSVCENPILQPYRIQPGNRSRHLTFYHPLFPPTTGQPLITSSYLLGAFCWAPKPSKVPTNLQPTLVA

SEQ ID NO: 37613 - DNA, 617 bp, Zea mays
  misc_feature: Ceres CLONE 1423811-F
  misc_feature: Encodes the peptide sequence at SEQ ID NO. 37614
atagctggagctccccgcggtggcggccgctctagaactagtggatcccccgggctgcaggaattcgcacgagaccattacctagaacatcctaatcgaaaagtacagccccgttcccatagaggacagtctgctgtctgccgcaagcctagcttcgtccaccactgaatcaagaaacaaaacaactaggcatggacgaccgcacctacaagggcggcatcaaggcgtactggaagcgccggggctactaccgcatggacggcgacgccgcgcggcgccgccagccgctccccaccgtggagctcggaagtggcgtcgcccaggcccaggcccaggcccagccgccggcgggggatggctcgggccggcgccgccggtgccgcgggtggcgcgtgcgccgcggccagctgggggcgcggctgctccgcgcgctgtcccctcgccgggtggtcatggggggttccgcgacccgaaacttgccccccaagggtgggggtgtggccccccccccccccccccctctggtgaaaggggggggggggggcccttttttggccccagggaaacacccggggggggggggggggggggggttttttggcgggggggggaaatta

SEQ ID NO: 37614 - protein, 142 aa, Zea mays
  misc_feature: Ceres CLONE 1423811-F
MDDRTYKGGIKAYWKRRGYYRMDGDAARRRQPLPTVELGSGVAQAQAQAQPPAGDGSGRRRRCRGWRVRRGQLGARLLRALSPRRVVMGGSATRNLPPKGGGVAPPPPPPLVKGGGGGPFLAPGKHPGGGGGGGFFGGGGKL

SEQ ID NO: 37615 - DNA, 658 bp, Zea mays
  misc_feature: Ceres CLONE 1423817-F
  misc_feature: Encodes the peptide sequence at SEQ ID NO. 37616
atagctggagctccccgcggtggcggccgctctagaactagtggatcccccgggctgcaggaattcgcacgagaccattacctagaacatcataatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcagcagcgtcagcagcccgttcctgggccagtgcgtcgagttcctgaggcaccagtgcagcccggcggcgacgccctacggctcgccacattgccaagcgctgcagcaacagtgctgccacaagatcaggcaagttaagccccctgcacggtaccaaggcgacataacggtgtggccctgcagtccttccctgccgcagcagccgcaggggcgagctcgccggcgctgattggcggcccaggttactccaccacctgacaggcgatg

SEQ ID NO: 37616 - protein, 150 aa, Zea mays
  misc_feature: Ceres CLONE 1423817-F
MKVLIVALALLALAASAASSTSGGCGCQTPPFHLPPPFYMPPPFYLPPQQQPQPWQYPTQPPQLSPCQQFGSCGVSSVSSPFLGQCVEFLRHQCSPAATPYGSPHCQALQQQCCHKIRQVKPPARYQGDITVWPCSPSLPQQPQGRARRR

SEQ ID NO: 37617 - DNA, 717 bp, Zea mays
  misc_feature: Ceres CLONE 1423819-F
  misc_feature: Encodes the peptide sequence at SEQ ID NO. 37618
  misc_feature (696)..(696): n is a, c, t, g, unknown, or other
tggagctccccgcggtggcggccgctctagaactagtggatcccccgggctgcaggaattcgcacgagaccattacctagaacatcataatcgaaaatttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcgtcggcgcggggcgcctcgccgacgccgcctcctccggccgcgcgtcccccgccggcgcagcttttcaactggccgggcgcccaccagccgcagctcttcccgcccggtccgggcgcgttccaccacccgtcggcgcgggcgatgccgccattgttcccaggcggcggcaaggacgagggccacatgttccacattccaccggcacaccatggcagcaagccactgcacatggacgagctccagcaccggcaccagcagacgatgggggccggtggcgaggcgcccgacggtgaactccggtggccccacgggctgtccttcttcaccgcgctcaccgggcgagacgacgacgcgaagctgctattcggtggccccggcgcccgcgacgacgagaaggcggcgccngacgcgcagaccgggcacggc

SEQ ID NO: 37618 - protein, 163 aa, Zea mays
  misc_feature: Ceres CLONE 1423819-F
MRHTFESLGYQSGFFLSQLFSSARGASPTPPPPAARPPPAQLFNWPGAHQPQLFPPGPGAFHHPSARAMPPLFPGGGKDEGHMFHIPPAHHGSKPLHMDELQHRHQQTMGAGGEAPDGELRWPHGLSFFTALTGRDDDAKLLFGGPGARDDEKAAPDAQTGHG

SEQ ID NO: 37619 - DNA, 706 bp, Zea mays
  misc_feature: Ceres CLONE 1423821-F
  misc_feature: Encodes the peptide sequence at SEQ ID NO. 37620
aagctggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgctttttagaatgtatcttaatttattgtagaggttttatcttcactcttt

SEQ ID NO: 37620 - protein, 118 aa, Zea mays; identical to SEQ ID NO: 12523
  misc_feature: Ceres CLONE 1423821-F
  misc_feature (13)..(116): Pfam Name: MAP1_LC3 Pfam Description: Microtubule associated protein 1A/1B, light chain 3

SEQ ID NO: 37621 - DNA, 422 bp, Zea mays
  misc_feature: Ceres CLONE 1423822-F
  misc_feature: Translation starting site: 331
  misc_feature (308)..(308): n is a, c, t, g, unknown, or other
aactggagctcaccgcggtggcggccgctctaaactagtggatcccccgggctgcaggaattcgcacgagaccattacctagaacatcctaatcaaaaaatctagggttctctcgtgctctgttctcatcttctgctcgctggtgtcccctccctctcacccatggcttcggcggcggcggcaactcagggtggggaacttaccttcctgcggaaactactacaacctgctgcaacaaacccccgatgtcgtccaccagttctacagcgaaaccagcaccatggtccgcgtcgaacgacctcaccggnacgaccggcggctgcaaacaacatgatggacatacactcactcctcaagggcttgaaactcccccaaattgaaaatcaaaaacggcccaaaatttttttttgggaaaaaccccc

SEQ ID NO: 37622 - DNA, 631 bp, Zea mays
  misc_feature: Ceres CLONE 1423823-F
  misc_feature: Encodes the peptide sequence at SEQ ID NO. 37623
  misc_feature (570)..(570): n is a, c, t, g, unknown, or other
  misc_feature (631)..(631): n is a, c, t, g, unknown, or other
ggagctccccgcggtggcggccgctctagaactagtggatcccccgggctgcaggaattcgcacgagaccattacctagaacatcctaatcgaaaagaagtctatctttttctcctcctgccgtacgtccggtccgttccagcttgcaaagcgctcgcgagctgctgccatggccggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccgccgcctctgggccgccgccgaggccgaggccggctatcgcgtgctcaccccgacgccgcacctctccatgggcccgcggagcagcgcctcgctcgccgcccgcatcgccaacatcggcgccgaagaggtggacgaggacgaccttcaccgcangtggggcggcgccttcgcccctcacgtcccggggccggtggacgcgtgggtcaccgcgctn

SEQ ID NO: 37623 - protein, 154 aa, Zea mays
  misc_feature: Ceres CLONE 1423823-F
  misc_feature: SWISSPROT Homolog: EC 1.5.3.1 Sarcosine oxidase
  misc_feature (134)..(134): Xaa is any aa, unknown, or other
MAGAGAPAVPQAGRPAPNFDVIVVGAGIMGSCTAHAAASRGARVLLLERFDLLHPLGSSHGDSRIIRDAYAQPRYLRMVRLARRLWAAAEAEAGYRVLTPTPHLSMGPRSSASLAARIANIGAEEVDEDDLHRXWGGAFAPHVPGPVDAWVTAL

SEQ ID NO: 37624 - DNA, 626 bp, Zea mays
  misc_feature: Ceres CLONE 1423834-F
  misc_feature: Encodes the peptide sequence at SEQ ID NO. 37625
aaagctggagctccccgcggtggcggccgctctagaactagtggatcccccgggctgcaggaattcgcacgagaccattacctagaacatcctaatcgaaaaaaaaaagcgaaaggagagaaggaatccgatccatccaagccaagccaaggcagagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacacctagctagtcatccttgccgacgacgatccaggtctctggatcgggggctggtcctatgcccggatgccaaatttgggccggaagggaagttgccttgaaattccggcccggggtccccgtgttttgtttcccctatcccccccccccagggttatttttttgcccccgggccccgctattttttttgtgataaaaaaacgggccctaaaaacccccggttctaacaaaaaaaaaaaaaaaaaaatttttttctctcccccc

SEQ ID NO: 37625 - protein, 58 aa, Zea mays
  misc_feature: Ceres CLONE 1423834-F
  misc_feature (6)..(56): Pfam Name: UPF0057 Pfam Description: Uncharacterized protein family UPF0057
MSEGTANCVDILIAIILPPLGVFLKYGCGHEFWICLLLTFLGYIPGIIYAIYAITKNT

SEQ ID NO: 37626 - DNA, 643 bp, Zea mays
  misc_feature: Ceres CLONE 1423841-F
  misc_feature: Encodes the peptide sequence at SEQ ID NO. 37627
tggagctccccgcggtggcggccgctctataactagtggatcccccgggctgcaggaattcgcacgagaccattacctagaacatcctaatcgaaaaaaaaaaagatggcccctaaattagtctttgttcttcctgttgtgctcctcgccttggcgctgcaggcgatcctccggccaccgccgccaaagctctgtggctccccaggtggccctcctctgacatctcccaggatcaagctcagggacggaaggtaccttgcgtacaaagaggatggagtacagagagacaaggccaggtacaagatcatcacagtgcacgcatttgatagcaccaaggacttcccctcgcctgtttctaaggagctcgtggaaggactgggaatttacctccttgcttatgacagagctggatatggggaaagtgaccccaatcccaaccggcatgtcaagagcgaggcgctagatatcgaggagcttgccgaccagctgggccttggccacaagttctatgtgctaggggccctccatggggagatactcggtttgggggatgcctccagtatatacctcacaggcttgccaggagctgccctgggttggcccattaacaactactggggggcctcgttcccaacttgaattg

SEQ ID NO: 37627 - protein, 177 aa, Zea mays
  misc_feature: Ceres CLONE 1423841-F
MAPKLVFVLPVVLLALALQAILRPPPPKLCGSPGGPPLTSPRIKLRDGRYLAYKEDGVQRDKARYKIITVHAFDSTKDFPSPVSKELVEGLGIYLLAYDRAGYGESDPNPNRHVKSEALDIEELADQLGLGHKFYVLGALHGEILGLGDASSIYLTGLPGAALGWPINNYWGASFPT

SEQ ID NO: 37628 - DNA, 518 bp, Zea mays
  misc_feature: Ceres CLONE 1423843-F
  misc_feature: Encodes the peptide sequence at SEQ ID NO. 37629
aaagctggagctccccgcggtggcggccgctctataactagtggatcccccgggctgcaggaattcgcacgagaccattacctagaacatcctaatcgaaaaacggaagtttcggcggcgccggcgtgctcgtgatctcaaccaaggcgtgtctccgctccggtcacccgtcactccacgcaaacatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggttgaggctgaccctgacgagtcctccccttaccctgctatgcttgctgctcaagacttcgcacaacgcctgcagggaactttggcattacctgccttgcccatttaagctttcgtggccccccgggaggcgcaacaagaccccaaaaacccc

SEQ ID NO: 37629 - protein, 95 aa, Zea mays
  misc_feature: Ceres CLONE 1423843-F
  misc_feature (28)..(96): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVEADPDESSPYPAMLAAQDFAQRLQGTLALPALPI

SEQ ID NO: 37630 - DNA, 529 bp, Zea mays
  misc_feature: Ceres CLONE 1423846-F
aagctggagctccccgcggtggcggccgctctagaactagtggatcccccgggctgcaggattcgcacgagaccattacctagaacatcctaatcgaaaaaacaagacagagagatacccgatcgccaccgccgaccggactcccctcaaaggcggccacagcacagcgagcatggggagaccggcatcagcatggggcctgccacccgccttggaaggaacccgggaaacttgtcttgggggggggtggaaaaaacccggggggccccaaattgaacaaagggggggggggggttcttaaaacctttttctttttttttggggcccctgttttttttttttttttaaagggggggggggaaaattttaaaaggggggccccccctgggggggggccccttcttttttttttttttgggggggggcccccccccacggggggggtgttttttacaacccccccccccccccctttgtggggggggggggggggcccccccccccccctcttagggaggtagttattctt

SEQ ID NO: 37631 - DNA, 651 bp, Zea mays
  misc_feature: Ceres CLONE 1423859-F
  misc_feature: Encodes the peptide sequence at SEQ ID NO. 37632
atagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcaggctcatccccagccacacccatgcccgtgccaacagccgcatccaagcccgtgccagctgcaaggaacctgcaagcgtggcagcaccccgatcctgggccagtgcgtcgagttcctgaggcatcagtgcagcccgacggcgacaccttactggtcgcctcaatgccagtcggtgccgcagcagtggtgccaacaactcag

SEQ ID NO: 37632 - protein, 60 aa, Zea mays
  misc_feature: Ceres CLONE 1423859-F
MPVPTAASKPVPAARNLQAWQHPDPGPVRRVPEASVQPDGDTLLVASMPVGAAAVVPTTQ

SEQ ID NO: 37633 - DNA, 678 bp, Zea mays
  misc_feature: Ceres CLONE 1423862-F
  misc_feature: Encodes the peptide sequence at SEQ ID NO. 37634
aagctggagctccccgcggtggcggccgctctagaactagtggatcccccgggctgcaggaattcgcacgagaccattacctagaacatcctaatcgaaaaaaaaaccgcaccgcaccgcaacgcgccaccgatccaccccgcgtcctcggcctccctccctccggcgagcggcggcgcgggcggccatggaggtgttctactacgtcgtgttcggcgcgctggccgccatcgtggcggggctcgagctcggcaagagcggcaaggaccgcgtcgccactacctccgcctttaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctccatgctcttcggcaccatcgtcggctccctcgccgacaaacaaggccgcaagagggcctgcatcacctactgcatcagctacatcctcagctgcatcaccaagcactcccccgagtacagggtcctcatgatcggccgcatcctcggaggcatcgccacctcgctgctcttctccgccttcgagtcctggctcgtcgcagagcacaacaagagaggctttgacccgcagtggctgtc

SEQ ID NO: 37634 - protein, 163 aa, Zea mays
  misc_feature: Ceres CLONE 1423862-F
  misc_feature (4)..(163): Pfam Name: DUF791 Pfam Description: Protein of unknown function (DUF791)
MEVFYYVVFGALAAIVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAEHNKRGFDPQWL

SEQ ID NO: 37635 - DNA, 662 bp, Zea mays
  misc_feature: Ceres CLONE 1423878-F
  misc_feature: Encodes the peptide sequence at SEQ ID NO. 37636
aagctggagctccccgcggtggcggccgctctagaactagtggatcccccgggctgcaggaattcgcacgagaccattacctagaacatcctaatcgaaaaagacaaaacagcgtccccctccctctactaaaaaaaaaatggaggcatgagctccgcctcctcctcgtctctcgccgatctccccaaaccctagccccgacctgaccgccggcgggcccgccggccggagaaggagtcgctcccacccacccaacttctgcggcggaaggggagcgggcggcggacgagatgccgtcgcacggggatctggaccggcagatcgcgcagctgcgcgactgcaagtacctgcccgaggcggaggtcaaggcgctctgcgagcaggccaaagccatccttatggaggaggggaacgtgcagcccgtgcgctgtcctggccccgtctgtggggacatccaccgccaggtctatgacctcatcgagttccttccgctcgggggcgaccctcccgacaccaactacctcttcatggggcgactacctcgatcgtgggtaccattcagccaaaaaagtttcctcggtaaggggcttgaaaagccgtttccgagattgaattaccttcctttgggagaaatcctgggggccagacacaatccctcaggg

SEQ ID NO: 37636 - protein, 124 aa, Zea mays
  misc_feature: Ceres CLONE 1423878-F
  misc_feature: SWISSPROT Homolog: EC 3.1.3.16 Phosphoprotein phosphatase
MPSHGDLDRQIAQLRDCKYLPEAEVKALCEQAKAILMEEGNVQPVRCPGPVCGDIHRQVYDLIEFLPLGGDPPDTNYLFMGRLPRSWVPFSQKSFLGKGLEKPFPRLNYLPLGEILGARHNPSG

SEQ ID NO: 37637 - DNA, 704 bp, Zea mays
  misc_feature: Ceres CLONE 1423884-F
  misc_feature: Encodes the peptide sequence at SEQ ID NO. 37638
  misc_feature (704)..(704): n is a, c, t, g, unknown, or other
aagctggagctccccgcggtggcggccgctctagaactagtggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaacccctgtattccacaatgccttattctgcttacaatgggccccaaaggtcctatcctgggaatgaatgcaacctgctggacctctcatcttgtcatggcaccctcccccctggctttgcttcctgccccaaaaagaaaaagggctttttctgggattttatgaaccaacttttatggaaggggggggagtttccgcgcggctgccccccaaaaacacgctgccgcctccctatttgaaccgggtctaagccctttgtgattccgaaaccccgggagaaaattggccccaaaaaccgggcacggcgttcttttgaaaccctcaccaagggtgtttttggggaactttctn

SEQ ID NO: 37638 - protein, 85 aa, Zea mays
  misc_feature: Ceres CLONE 1423884-F
MADELRSTSVGQKFHGQSVLLSRISSYSAMNNPCIPQCLILLTMGPKGPILGMNATCWTSHLVMAPSPLALLPAPKRKRAFSGIL

SEQ ID NO: 37639 - DNA, 654 bp, Zea mays
  misc_feature: Ceres CLONE 1423886-F
  misc_feature: Translation starting site: 183
  misc_feature: SWISSPROT Homolog: EC 1.2.1.12 Glyceraldehyde-3-phosphate dehydrogenase (phosphorylating)
aagctggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaagtgaaggactccaaaaccccttctctttggtgagaagggagttgctgtgtttggctgcaggaaccctgaggagatcccgtggggttcggttgggtgctgaatatgttgttgagtctactggtgttttcactgaccaggaggaggctgcacctcacttgaagggtggtgccaaaaaggttggccatctcttgctcctaacaggatgcccccctgtttgccgttggtggcaaacagagggaggacaagtctgaattaaaattttcccaatgctagctgccaacccaat

SEQ ID NO: 37640 - DNA, 672 bp, Zea mays
  misc_feature: Ceres CLONE 1423898-F
  misc_feature: Encodes the peptide sequence at SEQ ID NO. 37641
  misc_feature (542)..(542): n is a, c, t, g, unknown, or other
  misc_feature (672)..(672): n is a, c, t, g, unknown, or other
atagctggagctccccgcggtggcggccgctctagaactagtggatcccccgggctgcaggaattcgcacgagaccattacctagaacatcctaatcgaaaaaaccgcagcagggcgttgggcgagtgagtgagtcagtgaggctgggatagcagcagcagcatcagtgcgccgcactcaacttctcttcttgccgtgcggtgcggcgcggcgcggggaggcaccgcacggccgcaagcaatgccgcgccggcagaggacgcgcagcagcgaggagctcaaggcggaggacttcgtcgactcggtgctcaacttcggcggcgaggaggaggatggggaagaggagaagcaggaggccggcggggacggccagccggcggcggagttcaagtccaagaacctggaggccgagcggaagcggcgcggcaagctcaaccgcaacatcctcgcgctcagggccgtggtgccgaacatcaccaagatgagcaaggagtccaccctctcggacgctatcgacctcatcaagaagctccagaaaccagntccttgagctgcagcgccagctcgccgactcgcccggagaggcctgggagaagcagggcagcgcgtcgtgctctgaatccttcactgccacggaaaacatgccgtatcagggtcagatcgagctggtccn

SEQ ID NO: 37641 - protein, 102 aa, Zea mays
  misc_feature: Ceres CLONE 1423898-F
  misc_feature (51)..(98): Pfam Name: HLH Pfam Description: Helix-loop-helix DNA-binding domain
  misc_feature (101)..(101): Xaa is any aa, unknown, or other
MPRRQRTRSSEELKAEDFVDSVLNFGGEEEDGEEEKQEAGGDGQPAAEFKSKNLEAERKRRGKLNRNILALRAVVPNITKMSKESTLSDAIDLIKKLQKPXP

SEQ ID NO: 37642 - DNA, 647 bp, Zea mays
  misc_feature: Ceres CLONE 1423903-F
  misc_feature: Translation starting site: 183
  misc_feature: SWISSPROT Homolog: EC 5.5.1.4 Inositol-3-phosphate synthase
gctctagaactagtggatcccccgggctgcaggaattcgcacgagaccattacctagaacatcctaatcgaaaaaagcacccactgcattctcattcctcctcttactcttgctcgtgctgcgctggctgcctcgcttcgacttccattccacgagagcggggagaggggacgaaacgcaagatgttcatcacgagcttccgcgacaagagcccccacgtgcggaacggccccacggacatcgagtcgaactaccggtacgacacgaccgatctggtacacaacggcaaggaccgcgacatccgctgggacgtccgccccgtgtccgatcgagtacaacttccggaccatagacgcggaccccaagctcggggagatgcttgagcggtgggtatgcaacagcgggtccatattgacagcttgcgtcattgccgactcggagggtatctcatgcgccatctacgtaaagggcgctcaaagccaactactacggatccctctccagggcctcccccatcatagatgggcaattactatcgaggtagagatctgattcttccattcaacatgccccccttcccaagaacgcaccccatatcgaaaatcgtgttccttacggctgggcccttttccctttcattgaacctg

SEQ ID NO: 37643 - DNA, 675 bp, Zea mays
  misc_feature: Ceres CLONE 1423904-F
  misc_feature: Encodes the peptide sequence at SEQ ID NO. 37644
  misc_feature (584)..(584): n is a, c, t, g, unknown, or other
ctggagctccccgcggtggcggccgctctagaactagtggatcccccgggctgcaggaattcgcacgagaccattacctagaacatcctaatcgaaaaagtttatcctccaagtatgggcgccccgcggggtattctgtccgtcggtgagggtatgagagtcacttgcaccgggggagcggagatgaagccggttgtggggatcgtggtgtctaacaatatgcataactcagcggtggctgcatggcatcgtctcttccacatcacggtattagaccgctacgacaagcgcgcctccgagttcatggcacacgacgatgacgactcctgcaacattggccgaccgtgttaggctggatacttctatgctcttcgaccagactccacgtactgagttgttgatgacatgtctcacacactctacgtgtaccttctgcatcctgcacagcgtccagtgaacatgctatcagatactcacacgatggccgagctactgaatgatccttctgacctactcaaaacagatgcaatcgctgcttgtctgtctctcgctgtacgttagttccatgccgaatgtggatgccntgtttagaatgtgactaaaacatgctgcagccagcatctttgcttaatccttgtcgactagggtgggacccttgttcagggtactagccat

SEQ ID NO: 37644 - protein, 78 aa, Zea mays
  misc_feature: Ceres CLONE 1423904-F
MGAPRGILSVGEGMRVTCTGGAEMKPVVGIVVSNNMHNSAVAAWHRLFHITVLDRYDKRASEFMAHDDDDSCNIGRPC

SEQ ID NO: 37645 - DNA, 639 bp, Zea mays
  misc_feature: Ceres CLONE 1423905-F
  misc_feature: Encodes the peptide sequence at SEQ ID NO. 37646
tggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttcccgcgtcgatcgtcgggtctgcctgggatccgtattccggaaggggggattttgagcccctgggtttgccacccgccccccgagggaaccggttggggccgccaaggaccttcctcccccggccccaaagggggggtttggggccccaaaagggttaggggccccccccccctttttgggactttccccccggggggggggaaaaaaaaaaaaaaaaaagggcgccccccttttgtgttccccccgggggaaattttttcttttttttttgggggggaaaaacccccccccccctctcttttttt

SEQ ID NO: 37646 - protein, 29 aa, Zea mays
  misc_feature: Ceres CLONE 1423905-F
MAVQAHYHHHYHRESPFLVRYLPWPLCIF

SEQ ID NO: 37647 - DNA, 683 bp, Zea mays
  misc_feature: Ceres CLONE 1423907-F
  misc_feature: Encodes the peptide sequence at SEQ ID NO. 37648
aagctggagctccccgcggtggcggccgctctagaactagtggatcccccgggctgcaggaattcgcacgagaccattacctagaacatcctaatcgaaaaataggaatcatccatcgcgtctgtgctccccctcgcgcaatcctaccgcactcgcctcccgaaatcggccgccacggcgcctcacgccatggctcctgcccagcagctgcagctccctccgcctccggtggtctggcacgccgcctcctcgcccagatccgtccgtggtccgcccctccggcctcgcccagctccaaagctccctcctgctcgcgggcacgcgatctcgccctgggggccatgccctaggccgtcgtctcggctcgcgtccacctcgtccagcgtcacaagtggcgccgccgccggtgtcggctacttcgatctcccgcccgccgtcgactcgtccagcagtacctacgctctgaatccgatcccctcgccggtggcgacggcgtcggctgacccatccccaaactcggcgcgggagcccaagcggaagcgaactggcccgtgcggtccccgcatcaactcgaaccggagggacgaccagccgagtcagactcaagaccaccgggactcccggatttttttccaccaagcctggtaacgtcgttttttggtgactgaaggatggcctcccca

SEQ ID NO: 37648 - protein, 152 aa, Zea mays
  misc_feature: Ceres CLONE 1423907-F
MAPAQQLQLPPPPVVWHAASSPRSVRGPPLRPRPAPKLPPARGHAISPWGPCPRPSSRLASTSSSVTSGAAAGVGYFDLPPAVDSSSSTYALNPIPSPVATASADPSPNSAREPKRKRTGPCGPRINSNRRDDQPSQTQDHRDSRIFFHQAW

SEQ ID NO: 37649 - DNA, 687 bp, Zea mays
  misc_feature: Ceres CLONE 1423910-F
  misc_feature: Encodes the peptide sequence at SEQ ID NO. 37650
aagctggagctccccgcggtggcggccgctctagaactagtggatcccccgggctgcaggaattcgcacgagaccattacctagaacatcctaatcgaaaagcacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaagctgaccgtgacgagtcgtcaccttacgctgctatgcttgctgctcaagacgtcgcacagcgctgcaaggagcttgccattactgccctgcacattaagcttcccgccccccgaggcaacaagacaaaaaccctggaacctggggcccaatcctgccctcgggccccttgctcctttccggaataaaatccggaacctttgggggactttccccccggtccccattgaaaagacttccaaaaaaggggccgaaagaagggaaaaaaagcgtttacgcctccccccccccgcgggaatttgccccggtcctttgg

SEQ ID NO: 37650 - protein, 123 aa, Zea mays
  misc_feature: Ceres CLONE 1423910-F
  misc_feature (28)..(122): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADRDESSPYAAMLAAQDVAQRCKELAITALHIKLPAPRGNKTKTLEPGAQSCPRAPCSFPE

SEQ ID NO: 37651 - DNA, 700 bp, Zea mays
  misc_feature: Ceres CLONE 1423912-F
  misc_feature: Translation starting site: 184
caagctggagctcaccgcggtggcggccgctctagaactagtggatcccccgggctgcaggaattcgcacgagaccattacctagaacatcctaatcgaaaaacaccgagaatcacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtgggacatgccggggctgagcacgtgggacatcagggagcaggtggaggaccaccgggtggtggtgatcagcggctagcgacccccgggaggagcggcaaggacgcccaagtacctgcgcatggaagcgggcggaatgggcaagctcctcggaaaaattccgggctggccggaccaacccaaacctgaaacaaggggcgcccccctggtggcaggacggtgcatgatcccggggaaccatccaaaaagctgccccccgccggaagccccagaaaaacccagggaccattcaaggaattaaggccccccctaagggggaagaacctgtttttcggag

SEQ ID NO: 37652 - DNA, 680 bp, Zea mays
  misc_feature: Ceres CLONE 1423918-F
  misc_feature: Encodes the peptide sequence at SEQ ID NO. 37653
caagctggagctccccgcggtggcggccgctctagaactagtggatcccccgggctgcaggaattcgcacgagaccattacctagaacatcctaatcgaaaaattgctctccaaccaaacctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgttttttttttttggtcctcgtcgtcgtccggactccggacaggacaggacatgggcgcggaggcggcggagcgcgacagaatcaggggcccgtggagccccgaggaggacgaggcgctgctgcggctggtggagcggcaccccccccccaactggacggcgatcgggcgcggcgtcccgggccggtcgggcaaagtctgccgcccgcggtggtgcaaccagctgtcgccaagggtggcgccccctcccttcacggccgacaaggacgcggccatttcccgcgcccaactcccccctcgacaaaccggtgggccaccaatattggggcctgcttcccggggcgccaccaaaaaccccattcaagaaaccccttggaactgcttcccctaaggcacaagcttctggcgccc

SEQ ID NO: 37653 - protein, 112 aa, Zea mays
  misc_feature: Ceres CLONE 1423918-F
  misc_feature (12)..(58): Pfam Name: Myb_DNA-binding Pfam Description: Myb-like DNA-binding domain
MGAEAAERDRIRGPWSPEEDEALLRLVERHPPPNWTAIGRGVPGRSGKVCRPRWCNQLSPRVAPPPFTADKDAAISRAQLPPRQTGGPPILGPASRGATKNPIQETPWNCFP

SEQ ID NO: 37654 - DNA, 695 bp, Zea mays
  misc_feature: Ceres CLONE 1423920-F
  misc_feature: Translation starting site: 182
  misc_feature: SWISSPROT Homolog: EC 2.7.8.23 Carboxyvinyl-carboxyphosphonate phosphorylmutase
aaagctggagctccccgcggtggcggccgctctagaactagtggatcccccgggctgcaggaattcgcacgagaccattacctagaacatcctaatcgaaaatcgcctttccgatcccatccctctccagccaacatcctccgctcgccgcgattctgcttcctccgccaccaccgacagaatgggtgcgcactaccactacttcgccgtcaaggagtcctcccgcggcatccgctcgggggagtccccggccgcagcgctccgcctgatcctcgcgacgcctggtgcgcaccatgccgccctgctgctagccacgcgctccgtgcgcgcctcgtctagcgagcgcggtttccgatcaggtatcatgggcagtttctgtgtctctgccacacgactgtgactagctctgatgttggcctcatattcctatggagaaatggtagatacaagggctgtctcatcaatgaagctgactcatccccttgatcgctgatggagacaatggttacagaaactctatgcatatcacgataaccatcacaggatatatcactgctggatttgctgcaattatgcttgaggatcaagaggcacctaaagcatgtggacatactgaatgcacgagagtcttctcaagggaggaagctgtcctgctcataacagctgctgtagatgctaggacagagagtggctct

SEQ ID NO: 37655 - DNA, 675 bp, Zea mays
  misc_feature: Ceres CLONE 1423924-F
  misc_feature (223)..(223): n is a, c, t, g, unknown, or other
  misc_feature (258)..(258): n is a, c, t, g, unknown, or other
  misc_feature (321)..(321): n is a, c, t, g, unknown, or other
  misc_feature (324)..(324): n is a, c, t, g, unknown, or other
  misc_feature (325)..(325): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (346)..(346): n is a, c, t, g, unknown, or other
aaagctggagctcaccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgcgctgcctacgnggcgaacctatttgtccgcacacatggcgtcaaanaaaagagggcccaaaaaagggttccccttttttccctcggaacccctttaccagggggggggncgnntccnnnnnnnnnnnnnnnngnttgtgattgttgtttttccttcctttcccgcggtgccggtctggtgtcgcgggtttgttgggttcgcctatccgcgcgcggcggtgctccgagtcggcccgttgcgtagcggccacaaaaaaaatctacccacaaccccccccccgcctcgccaccataatttttctttcttctgtctctatttgctctatttctttttctggtctttcgccgtcggagtccacgccacggctagtgacgccgcgaggctaatagacaaatagtattatcaacatgggggtttgtggggaacgggtggtccgtggatgtacgtattttataaacttgat

SEQ ID NO: 37656 - DNA, 664 bp, Zea mays
  misc_feature: Ceres CLONE 1423927-F
  misc_feature: Encodes the peptide sequence at SEQ ID NO. 37657
aaagctggagctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctggaagctccagttgttgttgttacaggtgcctctagagggattggaaaggcaactgctctagcccttggaaaagcaggatgcaaggttctggtaaattatgctcggtcttcgaaagaggctgaagaggtctccaaagagattgaagcatctggtggtgaggctatcacctttggaggagatgtttcaaaagaagctgatgtagagtctatgatgaaagcagctctagatag

SEQ ID NO: 37657 - protein, 146 aa, Zea mays
  misc_feature: Ceres CLONE 1423927-F
  misc_feature: SWISSPROT Homolog: EC 1.1.1.100 3-oxoacyl-[acyl-carrier-protein] reductase
MAAAAAAAAAVSSPIAPRAVAAAASRRGFVTFGGGAARSSPTLRSGRGFSGVQTHVAAVEQAVVKDATKLEAPVVVVTGASRGIGKATALALGKAGCKVLVNYARSSKEAEEVSKEIEASGGEAITFGGDVSKEADVESMMKAALD

SEQ ID NO: 37658 - DNA, 760 bp, Zea mays
  misc_feature: Ceres CLONE 1423934-F
  misc_feature: Encodes the peptide sequence at SEQ ID NO. 37659
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (26)..(26): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
tttttnnncccccccccccccccctntccctccccctttcctgnttgggtnnnnnnntcaaagctggagctccccgcggtggcggccgctctagaactagtggatcccccgggctgcaggaattcgcacgagaccattacctagaacatcctaatcgaaaagagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgatgggttggtgccaagaaggttggcatttcctgctcctagcaaggaaggccccattggtcctttggttggcggcccacgcagaagggagttacaaggtctgggacatacaacatttggcctcctaagggcgaggctgggcacaaaccaaaattgttccttgggctcccgcctttgggcataagggg

SEQ ID NO: 37659 - protein, 155 aa, Zea mays
  misc_feature: Ceres CLONE 1423934-F
  misc_feature (4)..(130): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLMGWCQEGWHFLLLARKAPLVLWLAAHAEGSYKVWDIQHLAS

SEQ ID NO: 37660 - DNA, 682 bp, Zea mays
  misc_feature: Ceres CLONE 1423951-F
  misc_feature: Encodes the peptide sequence at SEQ ID NO. 37661
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaaagtcagagtcctcccaccgcacgcaacaagtacgcaggcagcgcagcctcgagccgtcgccatggcgagcaagcacctcgtcctcgccgcatgcctcctcctcctcctcctcctgcccatcgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggcaactggtcatcgacgtaaagtatttcttcttctacgtgcactcggagacccgcgacatctgcggagagacttcctgcccagcgaccggcgacttcgtgctgtcccaccagcagacgctgccaggtttccctccgccgaagaaactttgggtcaagagtagagtatccaataccccagaaacccttccgtatcgaaaaaaaccataggacaaaaaaaacagatgttttggaagggggccaatgaaaacacccttttattagcctagccttaaaggaatttcgggaatttctccagtaactaccagtatn

SEQ ID NO: 37661 - protein, 138 aa, Zea mays
  misc_feature: Ceres CLONE 1423951-F
  misc_feature (23)..(136): Pfam Name: E1_DerP2_DerF2 Pfam Description: ML domain
MASKHLVLAACLLLLLLLPIASVATDVDYCSKKDYPVKVSGVQIVPDPVEPGKPATFKISASTDKTIEKGQLVIDVKYFFFYVHSETRDICGETSCPATGDFVLSHQQTLPGFPPPKKLWVKSRVSNTPETLPYRKKP

SEQ ID NO: 37662 - DNA, 714 bp, Zea mays
  misc_feature: Ceres CLONE 1423965-F
  misc_feature: Translation starting site: 204
  misc_feature (430)..(430): n is a, c, t, g, unknown, or other
  misc_feature (487)..(487): n is a, c, t, g, unknown, or other
  misc_feature (543)..(543): n is a, c, t, g, unknown, or other
  misc_feature (544)..(544): n is a, c, t, g, unknown, or other
ggagctccccgcggtggcggccgctctagaactagtggatcccccgggctgcaggaattcgcacgagaccattacctagaacatcctaatcgaaaactcacaaaaccctcgccagcttatcccccttccctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagttctgcaagaatattgttctagctggagttggaagtttatccttgatggatgataatgtagtcacagaggaggatctgaatgcaaatttcttaattcctcctgatgagagcatatatggntggtagatctcgagccccagtttgctgcgagtctttgatagatttcaatcctatggntagagttttctgtgaaaagggtgatccatcattaattgatggagaattccttgacnnagtcgacatttgtgtacttagccgtgcatctcttaaacaaagttgttgattaatggaaactgtcgaaagagaagcaacataatgcattttatactatagattgcaaggattcatgtggtgaaatattgggtgatttacagagcataactatgtcagaaaaaagcgtggag

SEQ ID NO: 37663 - DNA, 806 bp, Zea mays
  misc_feature: Ceres CLONE 1423969-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (53)..(53): n is a, c, t, g, unknown, or other
nnnnnnnnnccccnnnnnnnncccccccccccccnngnggggtgttnnnnngntcatactggagctccccgcggtggcggccgctctagaactagtggatcccccgggctgcaggaattcgcacgagaccattacctagaacatcctaatcgaaaaagttcctacgccgcggcggcgcggcctctccattccggtgtgttctccgatttgggggacgtcccttgcccgctccggagtccggtccagcggagccagctacggcacagatcggcttccgtccgccccttcccatctcaccagactctgcaccgccgcggtgatcgtgcctcggctgcttcctagattactgcttcaggccgtgctgatgcaaaatggtttctatgtcagggcgttttctgttggaaatgctcagttgctagcttttcctggtagatcatcaagtttttaagagcaccccagtttcatgttaaaaacggatcattttttctggcaagaagcttctacgtgcctggcacctgatttccattccatccatgggcattggtctaacatcaatttccccaagggaaggaaattcctctccaagggggcattccccattcaccttattcagggggcaggcattaaattcacgccattccaaagggtcccgttttaggttgcccgggggcaccccctccctcgggcaactcttttcagcctaccccctggaggctggacacttccaaaccccacgaaatgggtgggtgtggaacaaccttctaggctttgtgggtgccccgacacctttggctggcccaattgcc

SEQ ID NO: 37664 - DNA, 671 bp, Zea mays
  misc_feature: Ceres CLONE 1423971-F
  misc_feature: Encodes the peptide sequence at SEQ ID NO. 37665
  misc_feature (537)..(537): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagtttcacgagggccccgtgggagcgaagcangcgctctactcgagggacctcgctcgcaacctgggcttcgccctccaactcgaactcttcaaggttctgcggccgaatgggccgaccccttcttttggaagggggtcccaacccccccccccgaaggacttccg

SEQ ID NO: 37665 - protein, 174 aa, Zea mays
  misc_feature: Ceres CLONE 1423971-F
  misc_feature: SWISSPROT Homolog: EC 1.14.11.20 Desacetoxyvindoline 4-hydroxylase
  misc_feature (130)..(130): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFHEGPVGAKXALYSRDLARNLGFALQLELFKVLRPNGPTPSFGRGSQPPPPKDF

SEQ ID NO: 37666 - DNA, 784 bp, Zea mays
  misc_feature: Ceres CLONE 1423973-F
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ttttggtggggaccccccnnnnaccccccnnnnnnnngagcggggccnnnnnnccaaagctggggctccccgcggtggcggccgctctagaactagtggatcccccgggctgcaggaattcgcacgagaccattacctagaacatcctaatcgaaaaccctttctgctcctgtgctgcgtccaccagcctcgtcgttaggacgtacggtaagacacccgggggcgagcctgtgagcaccgagagcagccttacgtagcgaacctcacagcatgctggggtacggtcaaggggggtgatggcgctgactcgacgcatgggggctcccgtcctggtcctcatggtcctcctcgtcgccacaggtgcccgactcaactccgcgttgctcgatcggtgctgcttgagtgacccttccaagctaagatcacagtaatgcgacgcgcttggcgttgtaatgctttacttcatcgcgcccggacggcgcagagctggggacgatcaaggtgggggggagccgaggcattgcctgttcgcctagcctctcggttcacggggcgtggtggtgcaccagcaacgacctggtcccaacttttggccggacccaaaaaattcccccctgacgtcgaatgggcaggggcgcaagggagccccccccggcgggggggcctctggcccgcattccattctgcctattcaaggaaggcactcgcccctggggtgccgggacacatgcgccgggttgcctcacagcacccggcttgccgggggagtgtaaaaaggcccggg

SEQ ID NO: 37667 - DNA, 693 bp, Zea mays
  misc_feature: Ceres CLONE 1423974-F
  misc_feature: Encodes the peptide sequence at SEQ ID NO. 37668
aaagctggagctccccgcggtggcggccgctctagaactagtggatcccccgggctgcaggaattcgcacgagaccattacctagaacatcctaatcgaaaaaaaaaaaaaaaaaaaaggcggagaagccaacgataccatccttgctcaaaaattcaaactccgataacctctcacgcgcctccctacgcgcaacgatcccaaattttcaaacgatggagccggcgaaggtagattccgatgcgaagactgtcaaggatccgaatccgagcgccgatccgaaagccgcggatcaaggaccggcgaagaaggtaggcgaggacgcgaacgccgagatcgccttgtcggaggtcgaaatcgagacgaaagggatcgatccagcagcggcgcaggcggaagcgcagccgccggcgaggacgtcgtctggatcgaagaaatcggtgcactggagccccgagctggtgtccgggtctcaggagccggatcagaagtccgcttcgtcgtacccggcgggatctaatccgtatattgctcgttctccggctgagacgtcggatgcttccttgaaagatacgatggagtctgtgaaaggagcgctttgggagatggggaagggagggttgctgaagctgctaagaagacggagagccttgccggcaacacgtggcagcacctgagaactgctccgagttt

SEQ ID NO: 37668 - protein, 153 aa, Zea mays
  misc_feature: Ceres CLONE 1423974-F
MEPAKVDSDAKTVKDPNPSADPKAADQGPAKKVGEDANAEIALSEVEIETKGIDPAAAQAEAQPPARTSSGSKKSVHWSPELVSGSQEPDQKSASSYPAGSNPYIARSPAETSDASLKDTMESVKGALWEMGKGGLLKLLRRRRALPATRGST

SEQ ID NO: 37669 - DNA, 712 bp, Zea mays
  misc_feature: Ceres CLONE 1423979-F
  misc_feature: Encodes the peptide sequence at SEQ ID NO. 37670
tccccgcggtggcggccgctctagaactagtggatcccccgggctgcaggaattcgcacgagaccattacctagaacatcctaatcgaaaagccgattcgcgcacgaagccgaactgtgagagagggaccccgccagttgtcacgagcttttatcacacaacttgccatcggtgcgaagctatccatttcttgttcgtcatgggcggcagcgtcaccgtggaaaacctcaaccccaaggtcttaaaatgtgagtatgcactccggggggagattgtcatccatgctcagcgcctgctgcaacaactacgaacacaaccggggtctcttccttttgatgacatcctctattgcaagattgggaatccccaatctcttgtgtcagcaacctgtgacattcttcaggcaggttcttgctctttgtgatcatccctgcctcttgcaaaaagaggaaacaaatcattgttcagtgctgatgcaatttctcgagcaaagcagattcttgcaactattcctggaacggcaacaggtgcatatactcgcagtcatgctatcagaggactgcgtgatgcaattgctgctaggatcatgtcacgtgatggactccctgcaaatgcatatgacattttcattacacacggaccaagtcctggggatcacatgatgatgcaactactgattaggaatgagaacatcgcattctggtgcccaatt

SEQ ID NO: 37670 - protein, 74 aa, Zea mays
  misc_feature: Ceres CLONE 1423979-F
  misc_feature: SWISSPROT Homolog: EC 2.6.1.2 Alanine transaminase
MGGSVTVENLNPKVLKCEYALRGEIVIHAQRLLQQLRTQPGSLPFDDILYCKIGNPQSLVSATCDILQAGSCSL

SEQ ID NO: 37671 - DNA, 712 bp, Zea mays
  misc_feature: Ceres CLONE 1423999-F
  misc_feature: Encodes the peptide sequence at SEQ ID NO. 37672
tggagctccccgcggtggcggccgctctagaactagtggatcccccgggctgcaggaattcgcacgagaccattacctagaacatcctaatcgaaaaagcaccagttgcttcacggcttcatcatcactccactagccagtcagctactggcctacagctagccgcctcctctcctctcatcccatcccatctcatctccgacaagcgaagcagagcactggcatgagcatggaccgcatggcgcggcgttccgtgtccttgctcctcgctctggctctcctggccgccgcggcgtcggcggactcgtggctgtacgagaagttcacgacggagggcaacgtgcgcgcggactacaacgcgcaggggcagcaggtgacgtctctgatcctgacgcagcagtccggcggcgccttcagctcgcggcagaagtacctgtacggggagttcagcatccagatgaggctgatcccgggcaactccgcgggcaccgtgacctccttctacctgtcgtcgggcgacgggcccgggcacgacgagatcgacatggagttcatgggcaacgccagcgggcagccccgtgtgctgaacaccaacgtgtgggccaacggcgaacgcaagaaggagcaccagttctacctgtggttccgaccgggccgcgacttccacactacacatcatctggaacgacagacgtcctcttcagggtgacga

SEQ ID NO: 37672 - protein, 161 aa, Zea mays
  misc_feature: Ceres CLONE 1423999-F
  misc_feature (30)..(162): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MSMDRMARRSVSLLLALALLAAAASADSWLYEKFTTEGNVRADYNAQGQQVTSLILTQQSGGAFSSRQKYLYGEFSIQMRLIPGNSAGTVTSFYLSSGDGPGHDEIDMEFMGNASGQPRVLNTNVWANGERKKEHQFYLWFRPGRDFHTTHHLERQTSSSG

SEQ ID NO: 37673 - DNA, 775 bp, Zea mays
  misc_feature: Ceres CLONE 1424001-F
  misc_feature: SWISSPROT Homolog: EC 6.3.2.19 Ubiquitin--protein ligase
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ggggnnnggcggggccggggcccggccgggcgccanggggggnnntggaatttgggcatactggagctccaccgcggtggcggccgctctagaactagtggatcccccgggctgcaggaattcgcacgagaccattacctagaacatcctaatcgaaaaagaattcgattccctttcccaagaaaccaagaacccagccccccaccatgacgagctcctcctctccttccagaaaggcgctgagcaagatcgcttgcgatcggctgcagaaagagctcgccgagtggtagcaaaacccccccgtcgggttcaagcacaaggtctccgataacctccaaaggtgggtaattgaggtcaccggagcgggcgggcaccctttacgccggcgaggcttaccagttgcgggttgacttccctgagcattatcctatgggaggcacccggggggcattttttctcattccagcggccggtggccgccacgcgttttacagtcaacggggcaacgtcgcgggatagaaaatccgggaatggagctcgggggcccaccccgcacatcgaccccgagggcacctggcgcggactccgggaagccgggtaaatgggtgggccacgcccccccagcgcaggcatcctcgccgcgcggaatatagccccgctttgggttaggagaaatgcccccaaaccgggggggctccaccgcggcgagactttattgtgtgtggtcctaaggacgaaacgagggggaaagggaaccaacaacggcacattggcc

SEQ ID NO: 37674 - DNA, 760 bp, Zea mays
  misc_feature: Ceres CLONE 1424007-F
  misc_feature: Encodes the peptide sequence at SEQ ID NO. 37675
  misc_feature (283)..(283): n is a, c, t, g, unknown, or other
  misc_feature (328)..(328): n is a, c, t, g, unknown, or other
ctggagctccccgcggtggcggccgctctagaactagtggatcccccgggctgcaggaattcgcacgagaccattacctagaacatcctaatcgaaaactctgctaacgccgctcgcgcatcctattgccctcgcgccaccgtcgccgccgctgcagcgagccaccgccctgccgtcgcctgaggtagacaccaagccaccgccatggggcgtatgcacagccgcgggaaggggtatctctcatcggcgctgccgtacagaagactccctcgatctggctcangacagctaccaccgaggtggaggaagatgattaccaaggctggcnaaaaaagggccaaatgccgtccacaaatggggtgttctgctcccgggaacaaaacgggaatcccggttggtaaaaaactgtgaactggaaaaaaaaacccccccccttccccaaggccccagggtgttggcccccgaaaaaccccggaaaatcccctcttttccctatataaaaaagggggggggtattataaaaacttttttgaaaagaaaacaggaaaaaaaaaaacccccccaaatttcaacccctctttttgtggaaagaaaaaaaaaaacccccttttgcgcctttttaataaagggcaaaaaaaagccccccccccccgcggagaagaaaaaaaaaaacgcgggggacccaccggggggggaaaaaaataatccccccccggggggggttttcctccccccaaaaatgttttttaaattttttata

SEQ ID NO: 37675 - protein, 68 aa, Zea mays
  misc_feature: Ceres CLONE 1424007-F
  misc_feature (27)..(27): Xaa is any aa, unknown, or other
  misc_feature (42)..(42): Xaa is any aa, unknown, or other
MGRMHSRGKGYLSSALPYRRLPRSGSXQLPPRWRKMITKAGXKRAKCRPQMGCSAPGNKTGIPVGKKL

SEQ ID NO: 37676 - DNA, 593 bp, Zea mays
  misc_feature: Ceres CLONE 1424010-F
  misc_feature: Encodes the peptide sequence at SEQ ID NO. 37677
  misc_feature (30)..(30): n is a, c, t, g, unknown, or other
ggcggccgctctagaatagtggatcccccngggctgcaggaattcgcacgagaccattacctagaacatcctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctgggtcaaccttcaggccgcactccccgccaacgctttgccaacgggcttgttattcttccttgggaactaacaaaaccgcgggcccgcaaaccccgaaggtccttggaatttcctcccggggcttccaaaagcgtttcccccggggagggccccctttttttctttgggggaaaaccaaaaccctcccttttttgggggttttctcgggggggttttccccccccccccccaaagaggtccccccttttttgggggccctggggggggagaatcctccccccccccaggagggcccagaggggggggggtccccccgcgggcgggtgttttttgtgggggtttc

SEQ ID NO: 37677 - protein, 50 aa, Zea mays
  misc_feature: Ceres CLONE 1424010-F
MSAPSAPPRTVICVGDVHGYITKLESLWVNLQAALPANALPTGLLFFLGN

SEQ ID NO: 37678 - DNA, 679 bp, Zea mays
  misc_feature: Ceres CLONE 1424019-F
  misc_feature: Translation starting site: 212
  misc_feature (679)..(679): n is a, c, t, g, unknown, or other
atagctggagctcaccgcggtggcggccgctctagaactagtggatcccccgggctgcaggaattcgcacgagaccattacctagaacatcctaatcgaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtggggcgccgggtccgcgggcctgtcctgcgcgtacgagctgtccaaggacccctccgtgagcgcccccatcctggagcagcccgtgtccccgggcggccgcacctggctgggcgggcagctgttctcggccatggaggtgcccaaggccggcccaccctgttcctggaacagctggggcgtgggctacan

SEQ ID NO: 37679 - DNA, 663 bp, Zea mays
  misc_feature: Ceres CLONE 1424021-F
  misc_feature: Encodes the peptide sequence at SEQ ID NO. 37680
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgcacc

SEQ ID NO: 37680 - protein, 108 aa, Zea mays; identical to SEQ ID NO: 16131
  misc_feature: Ceres CLONE 1424021-F

SEQ ID NO: 37681 - DNA, 727 bp, Zea mays
  misc_feature: Ceres CLONE 1424029-F
  misc_feature: SWISSPROT Homolog: EC 2.4.1.215 Cis-zeatin O-beta-D-glucosyltransferase
  misc_feature (471)..(471): n is a, c, t, g, unknown, or other
  misc_feature (545)..(545): n is a, c, t, g, unknown, or other
  misc_feature (575)..(575): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggtgccgttcccggcgcagggccacctgaaccagctgctgcacctgtccctgctcctggcatcgcgggggcttcctgtccacttcgccgcgccggagccgcacctccgggaggcccgcgcgcgcctgcacggctggnggcccgaccccgcgtcggtgtgcttcccgcgcgctgacgtgcccgcgcacgactccccctcccggacccatccntcccgttcccggcgcacatgcagcccctgntcgagcctttctgcaccggcgcgcgggcctcgctagccccgcctctggcggagcttggccccttcnaaccgccgcgtcgtcttcctctaagaccgcatgggggccttcccggggggccaaaggccccccccttacccaaagccagggccctt

SEQ ID NO: 37682 - DNA, 698 bp, Zea mays
  misc_feature: Ceres CLONE 1424033-F
  misc_feature: Encodes the peptide sequence at SEQ ID NO. 37683
  misc_feature (319)..(319): n is a, c, t, g, unknown, or other
tccccgcggtggcggccgctctagaactagtggatcccccgggctgcaggaattcgcacgagaccattacccagaacatcctaatcgaaaaatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtaagcagagcacccacgaatgcttgncattaatatttgacaacttctttccatatgcatgcgcgcgggcgtgcgtacgtcattatgatgcggcggcgcccgctcgcattcgcatcgcaagtggaaaaaccaccgcgtggaaccccccccttaatggacgaaggtcaaccgctttcttctacgggccattacgaaggagacaccttggagggccaagtttttaccccccccccccctccccctgggaaccccaagggccccccccccaagggggagccctgaggagaaaaccccccccaacaaagggggaaattgggaatccccctcattttttttcccgggaccccccccccaaaagaaaaaagtcgcccgaaaattttcccgaaaaataacccccccccccccc

SEQ ID NO: 37683 - protein, 50 aa, Zea mays
  misc_feature: Ceres CLONE 1424033-F
  misc_feature: SWISSPROT Homolog: EC 1.14.17.4 Aminocyclopropanecarboxylate oxidase
  misc_feature (49)..(49): Xaa is any aa, unknown, or other
MTGPMEIPVIDLGGLNGGGEERSRTLAELHDACKDWGFFWVSRAPTNAXH

SEQ ID NO: 37684 - DNA, 665 bp, Zea mays
  misc_feature: Ceres CLONE 1424052-F
  misc_feature: Encodes the peptide sequence at SEQ ID NO. 37685
aagctggagctccccgcggtggcggccgctctagaactagtggatcccccgggctgcaggaattcgcacgagaccattacctagaacatcctaatcgaaaaagtactttcgctagctcccttccgttcccttcccacgaaaaccggagagggagtgagaagaagcaacaagaagcggagagccaacgcgcaacgcaacgccctgagatggcggcgccggcgccggcgccgaagcaggaggagctgcagccgcacgccgtcagggaccagctgccctccgtctcctactgcctgacaagcccgcccccatggccggaggccgtcctcctcggcttccagcactacctcgtcatgctcggcaccaccgtcatcatccccaccgcgctcgtgccccagatggccggcggccatgaggagaaaggcgcgggtggtgcaaacccctgctgttcggggcccggaatccacaccgcttggtccagaagttccctcgggaaggcgccttcccaggcgggtatgggggggcccccttaacccctttcgtgggggcccaacctatttccaattcgtcctccggcggggcgggtaaagagggggcatccccccaaaccaccccagagaaaaaatttccgggggcccatacaagggggggggagaaccccaagaggg

SEQ ID NO: 37685 - protein, 107 aa, Zea mays
  misc_feature: Ceres CLONE 1424052-F
MAAPAPAPKQEELQPHAVRDQLPSVSYCLTSPPPWPEAVLLGFQHYLVMLGTTVIIPTALVPQMAGGHEEKGAGGANPCCSGPGIHTAWSRSSLGKAPSQAGMGGPP

SEQ ID NO: 37686 - DNA, 716 bp, Zea mays
  misc_feature: Ceres CLONE 1424054-F
  misc_feature: Encodes the peptide sequence at SEQ ID NO. 37687
  misc_feature (515)..(515): n is a, c, t, g, unknown, or other
  misc_feature (524)..(524): n is a, c, t, g, unknown, or other
  misc_feature (546)..(546): n is a, c, t, g, unknown, or other
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctgggtgtcgccatcctgnccggcgtgntgggcgccgcgtccaagctggncggcgtgcaccacgtgcgcgcctggcgcacgacagcctggcccacaacgcgcgtcgtcgctcatcgcctggccatcacggcgctcgccttcgggctggctgcaagagatcacatcggcggacacgcggctggcgctgcccgtgctggagccttctcatctcctggcttca

SEQ ID NO: 37687 - protein, 126 aa, Zea mays
  misc_feature: Ceres CLONE 1424054-F
  misc_feature (14)..(120): Pfam Name: AWPM-19 Pfam Description: AWPM-19-like family
  misc_feature (60)..(60): Xaa is any aa, unknown, or other
  misc_feature (63)..(63): Xaa is any aa, unknown, or other
  misc_feature (70)..(70): Xaa is any aa, unknown, or other
MAGIGRNMVAPLLVLNLIMYIIVIGFASWNLNHFINGQTNYPGVAGNGATFYFLGVAILXGVXGAASKLXGVHHVRAWRTTAWPTTRVVAHRLAITALAFGLAARDHIGGHAAGAARAGAFSSPGF

SEQ ID NO: 37688 - DNA, 629 bp, Zea mays
  misc_feature: Ceres CLONE 1424058-F
  misc_feature: Encodes the peptide sequence at SEQ ID NO. 37689
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
ctccccgcggtggcggccgctctagaactagtggatcccccgggctgcaggaattcgcacgagaccattacctagaacatcctaatcgaaaaccatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcagcctcgtcgaccacctccaggagcggctcggcgtcaccggccgcggcctttcgcgcccggccgccccttctttcccggggcccccgggggggggggggggggggggccccccccccccaaaaaaaaaaaaacccccccccccctaaaaaaaaaaaaaaaagagtttcccnnnttttttttttaaaaaaaaaaagggggcccccccccaccgcggggtttttta

SEQ ID NO: 37689 - protein, 119 aa, Zea mays
  misc_feature: Ceres CLONE 1424058-F
MASTTLSSAFTLLSRPSTSPCPAASLPRSSHAAPHIRRGRRAVAVACTATESPKILELGDAIAGLTLEEARSLVDHLQERLGVTGRGLSRPAAPSFPGPPGGGGGGGPPPPKKKKPPPP

SEQ ID NO: 37690 - DNA, 867 bp, Zea mays
  misc_feature: Ceres CLONE 1424063-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (322)..(322): n is a, c, t, g, unknown, or other
  misc_feature (324)..(324): n is a, c, t, g, unknown, or other
  misc_feature (330)..(330): n is a, c, t, g, unknown, or other
  misc_feature (331)..(331): n is a, c, t, g, unknown, or other
  misc_feature (357)..(357): n is a, c, t, g, unknown, or other
  misc_feature (534)..(534): n is a, c, t, g, unknown, or other
  misc_feature (572)..(572): n is a, c, t, g, unknown, or other
  misc_feature (581)..(581): n is a, c, t, g, unknown, or other
  misc_feature (582)..(582): n is a, c, t, g, unknown, or other
  misc_feature (584)..(584): n is a, c, t, g, unknown, or other
  misc_feature (593)..(593): n is a, c, t, g, unknown, or other
  misc_feature (598)..(598): n is a, c, t, g, unknown, or other
  misc_feature (603)..(603): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagctggagactccaccgcgngntggcgnngccgctctagaactagtggaatcccnccgggctgcaggaattcgcacgagaccattacctagaacatcctaatcgaaaaattccactgtttctctctcgaaatcggccgtctctctcccgtccggcacttcctccgatcgactagcctgcggcggcgccggcgccggcgaaccagcgccatgcgggtgggcaccagggtgctnctcctcgtccgcgacgccgcgggctacggggctgcccntcgcgaagnngntccgcccgncgccnggggntaactagggaggcctccgccctttcaagcctcccccttggaaaaagtaccgccctccaacgagaaaaaaaggggtttggcccccaaccccctgaaactttttcccaaatcccaggggggctcccccccaagggggaacccctttttttgtttctggcccaaaaaaaaaaaaaaccacccccctttttgaaacgggggggtgttaaaaaaggggggccctttggaaaaaaaaaatttttttttttaaaaaaacacccccccccgg

SEQ ID NO: 37691 - DNA, 617 bp, Zea mays
  misc_feature: Ceres CLONE 1424064-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (175)..(175): n is a, c, t, g, unknown, or other
  misc_feature (178)..(178): n is a, c, t, g, unknown, or other
  misc_feature (182)..(182): n is a, c, t, g, unknown, or other
  misc_feature (184)..(184): n is a, c, t, g, unknown, or other
  misc_feature (185)..(185): n is a, c, t, g, unknown, or other
  misc_feature (192)..(192): n is a, c, t, g, unknown, or other
  misc_feature (193)..(193): n is a, c, t, g, unknown, or other
  misc_feature (207)..(207): n is a, c, t, g, unknown, or other
  misc_feature (215)..(215): n is a, c, t, g, unknown, or other
  misc_feature (216)..(216): n is a, c, t, g, unknown, or other
  misc_feature (224)..(224): n is a, c, t, g, unknown, or other
  misc_feature (232)..(232): n is a, c, t, g, unknown, or other
  misc_feature (367)..(367): n is a, c, t, g, unknown, or other
  misc_feature (369)..(369): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagctgggagactccaccgncgngggngnncggccgnnctctagaaactagntggaatcnnccccgggnctgcaggnaattcgcacgagaccattacctagaacatcctaatcgaaaaatcaccaccactgggtcttcagaccattagctttatctactccagagcgcagaagaacccgatcgacaccatgaaggtgttgctcgttgccctngntcttctgggtcttgctgcaaggcgcaccctccacgaatacaaacggggggctgcggtttgcaaccacccccccccggtttttattaaacgcccccggggggaattggcccactccggggtttccccggggccccccccgggggggatttccccccccgcgggggggtaacctgggggccccccccgggtccccttggggcacccccggggggtttttttgtggcccccccccccgtttttatttgggg

SEQ ID NO: 37692 - DNA, 664 bp, Zea mays
  misc_feature: Ceres CLONE 1424079-F
  misc_feature: Encodes the peptide sequence at SEQ ID NO. 37693
  misc_feature (608)..(608): n is a, c, t, g, unknown, or other
  misc_feature (609)..(609): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaagcagctagctagcgacgaccatggtctcctcgaacaccatccgcacggccatcggcgtcatcggcaatgggaccgccctggtgctcttcctctccccggtgcctacgttcatccgcatctggaagaaggggtcggtggagcagtactcgccgatcccgtacgtggcgacgctgctgaactgcatgatgtgggtgttgtacgggctgccgctggtgcacccgcacagcatgctggtgatcaccatcaacggcaccggcatgctcatccagctgacctacgtggcgctcttcctcgtctactccgcgggggcggcgcgccnnaatgcctgcagctcgcactgtcgcaggttctcatagctcatgctaannnnnnnnn

SEQ ID NO: 37693 - protein, 111 aa, Zea mays
  misc_feature: Ceres CLONE 1424079-F
  misc_feature (9)..(98): Pfam Name: MtN3_slv Pfam Description: MtN3/saliva family
  misc_feature (100)..(100): Xaa is any aa, unknown, or other
MVSSNTIRTAIGVIGNGTALVLFLSPVPTFIRIWKKGSVEQYSPIPYVATLLNCMMWVLYGLPLVHPHSMLVITINGTGMLIQLTYVALFLVYSAGAARXNACSSHCRRFS

SEQ ID NO: 37694 - DNA, 655 bp, Zea mays
  misc_feature: Ceres CLONE 1424080-F
  misc_feature: Encodes the peptide sequence at SEQ ID NO. 37695
tggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgt

SEQ ID NO: 37695 - protein, 108 aa, Zea mays; identical to SEQ ID NO: 16131
  misc_feature: Ceres CLONE 1424080-F

SEQ ID NO: 37696 - DNA, 704 bp, Zea mays
  misc_feature: Ceres CLONE 1424084-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (394)..(394): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactccccgcggtggcggccgctctagaactagtggatcccccgggctgcaggaattcgcacgagaccattacctagaacatcctaatcgaaaaataccacggctcgccttcctaatctcgggactcgggtccgcgatgcgagccaccaagagatccacgaatatacccatcccattccccacaaggctccgtcccttcggcggcggcggcgatgtctctccccccctggccgggcgacagtggcaccggcacggagacgactgggtcctcgactgcngcatcctcgacgacctgcccagcgcggcctgcgggggcctccccgtgggaagcgtccccgtcgttcttcaaacccagggtggagagtgggcagcctatttaaccgcccatgatggccttcaggaagccaatggaaggctttcagggaacccgggccccaattaaacatttaccggcccggatcccggggatttgcccacaccttaaaccctttcgggggaaaaaattggggggggaaaacccttcaaatggaaggggtttccttaaaaagggggggctgcccttttaaaacccgggagaaacccccggaa

SEQ ID NO: 37697 - DNA, 691 bp, Zea mays
  misc_feature: Ceres CLONE 1424087-F
  misc_feature: Translation starting site: 302
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (418)..(418): n is a, c, t, g, unknown, or other
  misc_feature (436)..(436): n is a, c, t, g, unknown, or other
  misc_feature (487)..(487): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttcaaactgggactcaccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaagcgcagcagcagcagaagcagggcgccatgatgacngcgctcaaggccgcgacngccgcgacctttcggcgggtcgatgctggtgctgtccgggctgatcctggncgggcacgtgatcgcgctcacggtggccacccccgtgctggtgatcttcacccggctgggtgggcgccgggccgccttcgccttggccctcatgggcggcccgggttcttcacctcccgggggcctccggggtcccttgccccttccggggttctcccgggaaggacaaataccccggaaggggaaagcacccccccgggggcc

SEQ ID NO: 37698 - DNA, 568 bp, Zea mays
  misc_feature: Ceres CLONE 1424094-F
  misc_feature: Encodes the peptide sequence at SEQ ID NO. 37699
  misc_feature (67)..(67): n is a, c, t, g, unknown, or other
  misc_feature (247)..(247): n is a, c, t, g, unknown, or other
  misc_feature (283)..(283): n is a, c, t, g, unknown, or other
  misc_feature (336)..(336): n is a, c, t, g, unknown, or other
  misc_feature (341)..(341): n is a, c, t, g, unknown, or other
aactggactcccgcggtggcggccgctctagaactagtggatcccccgggctgcaggaattcgcacngagaccattacctagaacatcctaatcgaaaacttgtttcctggcggcgacggctggtcgagcggcgccgcccttggctaggtcttcgctgggtccttccccggcgacgagcgtccatctggggtcgactgaactgagcaggcagtaggaagagacactatgttgttcttctcctacttncaggagctggtggggaagggagtgacagtggagctncagaatgacttggcgatcccgcggacgctccactcggttgaccagtacctcancatcnagcttcgagaacccccgccgtagtcgaaccgggaaaaaggattccccacctttggtttttcaagggcgggaaaaattgttttttttctacggggggccccccggggggggggggggaaaaaaaaatttttgtccccccccccccccgggggggggggggggggggagaataaaaaattttttttttttaacaaccccccccccgggggggggggggggggggggggg

SEQ ID NO: 37699 - protein, 45 aa, Zea mays
  misc_feature: Ceres CLONE 1424094-F
  misc_feature (7)..(7): Xaa is any aa, unknown, or other
  misc_feature (37)..(37): Xaa is any aa, unknown, or other
  misc_feature (39)..(39): Xaa is any aa, unknown, or other
MLFFSYXQELVGKGVTVELQNDLAIPRTLHSVDQYLXIXLREPPP

SEQ ID NO: 37700 - DNA, 596 bp, Zea mays
  misc_feature: Ceres CLONE 1424100-F
  misc_feature: Encodes the peptide sequence at SEQ ID NO. 37701
  misc_feature (416)..(416): n is a, c, t, g, unknown, or other
  misc_feature (443)..(443): n is a, c, t, g, unknown, or other
  misc_feature (458)..(458): n is a, c, t, g, unknown, or other
  misc_feature (466)..(466): n is a, c, t, g, unknown, or other
  misc_feature (467)..(467): n is a, c, t, g, unknown, or other
  misc_feature (497)..(497): n is a, c, t, g, unknown, or other
  misc_feature (510)..(510): n is a, c, t, g, unknown, or other
  misc_feature (553)..(553): n is a, c, t, g, unknown, or other
  misc_feature (556)..(556): n is a, c, t, g, unknown, or other
  misc_feature (564)..(564): n is a, c, t, g, unknown, or other
ggagctccccgcggtggcggccgctctagaactagtggatcccccgggctgcaggaattcgcacgagaccattacctagaacatcctaatcgaaaagtttttgcagattgctggttatgacaaaccgtcttcaaatgtcaatacctcagtaatgctcaatcctgtaccctcttcaaatggcaataatccagtaacgcctaagctcaaccctataccattaccaaaacagactcaaataatgtgttgtagtgacatgcctgtctctcgtaccctagcatatcaggtggtaaacgggaggattggaggttatgtcttttctctcactccttatccatatggttttcaaggtgagatactttcctgagcctgttaatacatgttccaaactgcagttatataaacatgatcatcgtatngttcctctttatgaccagctttatcangtggacaagtacacngccatggnncagtaagcaaccgtacctatgattacatangcaggattttggntctgttctgagcattgtcatggaggtccctgttatgatttccnttngcccatgnaagtgcgaaattgaaccagtcgatcatgtacc

SEQ ID NO: 37701 - protein, 70 aa, Zea mays
  misc_feature: Ceres CLONE 1424100-F
MLNPVPSSNGNNPVTPKLNPIPLPKQTQIMCCSDMPVSRTLAYQVVNGRIGGYVFSLTPYPYGFQGEILS

SEQ ID NO: 37702 - DNA, 679 bp, Zea mays
  misc_feature: Ceres CLONE 1424101-F
  misc_feature: SWISSPROT Homolog: EC 2.7.11.7 [Myosin heavy-chain] kinase
aagctggagctccccgcggtggcggccgctctagaactagtggatcccccgggctgcaggaattcgcacgaagaccattacctagaacatcctaatcgaaaaaaccgcatcatcctttacctcgcgccgccgtcaaaacaacccttgcagacacaatccctcacatcaaccatggactgggacggaggagtccctctatatgatggtcacgatgcccagccacgacacccaggtgaccgcgatctcgacccccatccagaactcggcgttcatcatctcctcctcccgcgacaagtacctgtatggtgtgggacctgagcaacgcggtccactaccaacccagaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtct

SEQ ID NO: 37703 - DNA, 605 bp, Zea mays
  misc_feature: Ceres CLONE 1424103-F
  misc_feature: Translation starting site: 253
  misc_feature: Pfam Name: SAC3_GANP Pfam Description: SAC3/GANP/Nin1/mts3/eIF-3 p25 family
  misc_feature (304)..(304): n is a, c, t, g, unknown, or other
  misc_feature (308)..(308): n is a, c, t, g, unknown, or other
  misc_feature (309)..(309): n is a, c, t, g, unknown, or other
  misc_feature (416)..(416): n is a, c, t, g, unknown, or other
aagctggagctccccgcggtggcggccgctctagaactagtggatcccccgggctgcaggaattcgcacgagaccattacctagaacatcctaatcgaaaaaggatccattaacacccctacgtacgcctttcctctggaaacccttctctcgcctgcctctcccccgccgcgccgccacttcccctctcccgtcaactccggcttccgcgcgaggtcgagctagcgtttggagttctcgagacgtgctgtgatggcgacagagccagcggcggagaactacacggtggacgacctcgtggccntgannccctactaccccgacatcctcaacgacctcgagaagttcatcaatgaacaggtctcatctcaaactattactgggatggcaatctcagtcttcttcctttgtacagntttgaccccgacaggatgagcctccgattggtggccaaatactgatttaggcctctcctggaaatgccagcccctgaactcagtttggtgcttattcttaaacccggaaaccttgcgcaatggaggaaccaatccagggattgaaaggttccttccccccccccaaagaaccgggggggttccgtacat

SEQ ID NO: 37704 - DNA, 565 bp, Zea mays
  misc_feature: Ceres CLONE 1424130-F
  misc_feature: Encodes the peptide sequence at SEQ ID NO. 37705
  misc_feature (52)..(52): n is a, c, t, g, unknown, or other
  misc_feature (269)..(269): n is a, c, t, g, unknown, or other
aaagctggagctccccgcggtggcggccgctctagaactagtggatcccccngggctgcaggaattcgcacgagaccattacctagaacatcctaatcaaaaaacacaaacaagaagcttgcattgttcgtttgctcgatcgttgcagataatggagaaccctgctccgagtatcgtagtgccccccattgccgcacctgtatcagcgaacttcagcagactcgccttcccgcacctgtacatccgacggacgggtccagacagcaggnagatggtgactgtggagggaaagagaggctctagtgatcagacaggcgacatggagtacgtgagtgacttccccgtctaccatggccgtgggctccaccccctcctggtgggtcccgtgcaagggctcacaacccccgttcgggaatcccaccagttctttcccgtccccttttaagggcgggacagggttcaaggggtcccccttccctttaccaaggggtggtggccggtgggttccaataaatgggccattttccgcggggaaccggaaaatttttctttggggaaaaggggt

SEQ ID NO: 37705 - protein, 97 aa, Zea mays
  misc_feature: Ceres CLONE 1424130-F
  misc_feature (40)..(40): Xaa is any aa, unknown, or other
MENPAPSIVVPPIAAPVSANFSRLAFPHLYIRRTGPDSRXMVTVEGKRGSSDQTGDMEYVSDFPVYHGRGLHPLLVGPVQGLTTPVRESHQFFPVPF

SEQ ID NO: 37706 - DNA, 821 bp, Zea mays
  misc_feature: Ceres CLONE 1424136-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (199)..(199): n is a, c, t, g, unknown, or other
  misc_feature (404)..(404): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttnnnnnnnnnccaaactggnactccaccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaagtggagcagncacagggacacgccgaagctgttcaacccgctggaaccttcgatgatgtcccaggtgaacgacatcttcgctgaccgaactaacctcgctttggaccccaaacaaaacccccgaatgttacctgcccgacaaccgggggggctttacccccaaaagaagggttccccaaagggcccaatgcccccaaatgttaaagggccccccaaaaaaatccccctctggaggaccggggggccccaaacaaccggaaaaaaagaggttgggggttttccccactattaaagaaaaacccccggggaaaaaatatccccggtgggcccccggggggcacaccccctccccgggggttttttccaaaacccattatttataaaaggggggccccccccgggggaaggcccccccccctttttggtt

SEQ ID NO: 37707 - DNA, 729 bp, Zea mays
  misc_feature: Ceres CLONE 1424149-F
  misc_feature: Encodes the peptide sequence at SEQ ID NO. 37708
aaagctggagctccccgcggtggcggccgctctagaactagtggatcccccgggctgcaggaattcgcacgagaccattacctagaacatcctaatcgaaaaaaacatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagccaagcaggaaagcccccggcattgctagctgtacgtgtctgtgtgtgcatctgcagcatggtgcaggcaggggccccgtacgtacctgtctccttctctctcatcatcttgccaccgtacctatctagaaggggggtcttcctaccaaataaaatgttcctgtcatcctcacttaaagctggggatatccgctctgaaca

SEQ ID NO: 37708 - protein, 115 aa, Zea mays; identical to SEQ ID NO: 13678
  misc_feature: Ceres CLONE 1424149-F
  misc_feature (41)..(115): Pfam Name: Tryp_alpha_amyl Pfam Description: Protease inhibitor/seed storage/LTP family

SEQ ID NO: 37709 - DNA, 829 bp, Zea mays
  misc_feature: Ceres CLONE 1424153-F
  misc_feature: Encodes the peptide sequence at SEQ ID NO. 37710
  misc_feature (462)..(462): n is a, c, t, g, unknown, or other
  misc_feature (463)..(463): n is a, c, t, g, unknown, or other
  misc_feature (485)..(485): n is a, c, t, g, unknown, or other
  misc_feature (497)..(497): n is a, c, t, g, unknown, or other
  misc_feature (538)..(538): n is a, c, t, g, unknown, or other
  misc_feature (561)..(561): n is a, c, t, g, unknown, or other
  misc_feature (562)..(562): n is a, c, t, g, unknown, or other
  misc_feature (567)..(567): n is a, c, t, g, unknown, or other
  misc_feature (569)..(569): n is a, c, t, g, unknown, or other
  misc_feature (696)..(696): n is a, c, t, g, unknown, or other
  misc_feature (697)..(697): n is a, c, t, g, unknown, or other
  misc_feature (714)..(714): n is a, c, t, g, unknown, or other
  misc_feature (725)..(725): n is a, c, t, g, unknown, or other
  misc_feature (753)..(753): n is a, c, t, g, unknown, or other
  misc_feature (754)..(754): n is a, c, t, g, unknown, or other
  misc_feature (799)..(799): n is a, c, t, g, unknown, or other
  misc_feature (827)..(827): n is a, c, t, g, unknown, or other
  misc_feature (829)..(829): n is a, c, t, g, unknown, or other
atagctggagctccccgcggtggcggccgctctagaactagtggatcccccgggctgcaggaattcgcacgagaccattacctagaacaccctaatcgaaaaaccgcatcccacaacccccgagctcagcttagctccactccagctccaatcgcagtcgtgaccagagcgcgagagctagctagagggccgtgaaaatgccgatcaataggatcgccctggggagccacggttataactccgccctttttccccacccccccccccccgggaaagtacccccctcccccccgcccgccctctttttcctccgagcacccccccccccgccggaaaaaacccccccctctttgggggccccccccggggggaaatttaaaaaacccccgggtgtttccccggaaaaaaaaaaaaaccccccccccggtgtgaacccccccccccccctctttgtttatatannaccccccccccccccccggggncccccccccctnttgggggggtggtcttcaacaacacaacaaaacaacaaaantttgggggggggggggggggtgnntggtntncggggcggggtggggggtggggggggggtggtatatttttattaattcttttctttccgcaagcaagattaagacgcctaactaactacatggagcactttcttcgagggggtcgtctactgtctcnnttctaccacagggtccntgggagaattnccacccccctactatacaccccccgatnntacgccgcgctcccggcgggtatcggaggacgagggagtggagtntcccgcggctcgtgagctgcgtgttttntn

SEQ ID NO: 37710 - protein, 51 aa, Zea mays
  misc_feature: Ceres CLONE 1424153-F
  misc_feature (13)..(13): Xaa is any aa, unknown, or other
  misc_feature (19)..(19): Xaa is any aa, unknown, or other
  misc_feature (23)..(23): Xaa is any aa, unknown, or other
  misc_feature (32)..(32): Xaa is any aa, unknown, or other
MEHFLRGGRLLSXFYHRVXGRIXTPLLYTPRXYAALPAGIGGRGSGVSRGS

SEQ ID NO: 37711 - DNA, 745 bp, Zea mays
  misc_feature: Ceres CLONE 1424164-F
  misc_feature: Encodes the peptide sequence at SEQ ID NO. 37712
agagctggagctccccgcggtggcggccgctctagaactagtggatcccccgggctgcaggaattcgcacgagaccattacctagaacatcctaatcgaaaaagtaagtaagaacagatgtcaaacaacacttcccatgttcctcccatgcccctctctcatcacttcagcgactatggcttcgatccccagatcgactactttcaggttttggaagaagcgaggaagcacaagaaagaaactccctccattgacagtatacatcagttcaagctccagaaacctatatctaaggatgatctgatccgaaccgctctccacaagaagaagaagcgctggttcttgaaaaacgctatgctcttcttcagctggcggaaatggcgaaggcgaggcagtcattacgcagaggaaggagacgtggagatggaactcgacgttcacatggcgagggctaggaactttcgcgccacatcagtcgtcggagccggttcgatatctggtccggtttacgtgacggagagctggagcggttcgagcacaccgtaccgaacgataagaccttcttcgctgacgtcgacgccagctgctgttccgtatatgagtctacgggagcttaacatggagcggcaacagaggagcaacgcatcttcttctaggtcgggtcctctttacttggtcacgtgatttatacattatcgggatggacgaaaaatgaataaagtttaaagtacatatttgggtgggg

SEQ ID NO: 37712 - protein, 178 aa, Zea mays
  misc_feature: Ceres CLONE 1424164-F
MPLSHHFSDYGFDPQIDYFQVLEEARKHKKETPSIDSIHQFKLQKPISKDDLIRTALHKKKKRWFLKNAMLFFSWRKWRRRGSHYAEEGDVEMELDVHMARARNFRATSVVGAGSISGPVYVTESWSGSSTPYRTIRPSSLTSTPAAVPYMSLRELNMERQQRSNASSSRSGPLYLVT

SEQ ID NO: 37713 - DNA, 658 bp, Zea mays
  misc_feature: Ceres CLONE 1424169-F
  misc_feature (70)..(70): n is a, c, t, g, unknown, or other
  misc_feature (72)..(72): n is a, c, t, g, unknown, or other
  misc_feature (84)..(84): n is a, c, t, g, unknown, or other
  misc_feature (257)..(257): n is a, c, t, g, unknown, or other
aagctggagctccccgcggtggcggccgctctagaactagtggatcccccgggctgcaggaattcgcacnanacccaagctggnactccccgcgggtggcggccgctctagaactagtggatcccccgggctgcaggaattcgcacgagaccattacctagaacatcctaatcgaaaactgcctgagcgaagctccctccatatttgcattcttcaccctcgcttcacgtcaccacatttgccatccagaacaattnagcggacacggaaacaaagagagaatggggcttccccggcgaactcttgccctgccttctggtctgtgtcgccacggaggccccccaaccaccaaaaggcgggcggggaaaccctttcctgaggggtcccggggaccccccccttttgggaggggggggaagaccttttttccccaaggggtttaaccccctatggggttttaaaatttttggggccaacccccccgcgaaggggaaaagggcacccttggggtttataaagaggggcgggggggcgggccttctctggggccagaaattgtggtttttttacaaacaagggggggggggggggaaacccctttttatattctccccccgcccccctcaaaaaaaaaacccccctcccggggggggtgttt

SEQ ID NO: 37714 - DNA, 741 bp, Zea mays
  misc_feature: Ceres CLONE 1424172-F
  misc_feature: Encodes the peptide sequence at SEQ ID NO. 37715
aaagctggagctccccgcggtggcggccgctctagaactagtggatcccccgggctgcaggaattcgcacgagaccattacctagaacatcctaatcgaaaaaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaaggtatggatctcgctcgccttactcgagaagcacaaggtaccgaagtcgctttaggagtgtcgactctagtgatgctgaaaaccctgggaacaacctgtatgtgactggtttgtcagctcgtgtaacggatcgagatctggagaagcacttctccactgagggtgaggtgattgatgcaagcgttgtatatgatccttggacaagggaatcacggggttttggttttgttaccatggctgctgttaaagatgcagatcgctgcatcaaatatctggaccgttctgtgttgcaaggtcgggtcataactgttgagaagattttgttgacagcaacagggtagatgttggtagctgctctgcaacaaactgatacaacctaacaccaaaccatgccaacctcagccaaagggttgtatgccctacattgcatagagaagacgaggtagaacccaacacctgggaagtatcttggcacaaaatcatcccgtggacggaggtactccaca

SEQ ID NO: 37715 - protein, 120 aa, Zea mays
  misc_feature: Ceres CLONE 1424172-F
  misc_feature (40)..(111): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSYSRGSRYGSRSPYSRSTRYRSRFRSVDSSDAENPGNNLYVTGLSARVTDRDLEKHFSTEGEVIDASVVYDPWTRESRGFGFVTMAAVKDADRCIKYLDRSVLQGRVITVEKILLTATG

SEQ ID NO: 37716 - DNA, 728 bp, Zea mays
  misc_feature: Ceres CLONE 1424174-F
  misc_feature: Encodes the peptide sequence at SEQ ID NO. 37717
  misc_feature (87)..(87): n is a, c, t, g, unknown, or other
  misc_feature (96)..(96): n is a, c, t, g, unknown, or other
aaagctggagctccccgcggtggcggccgctctagaactagtggatcccccgggctgcaggaattcgcacgagaccatcaaactganactccaccncgaataacggaccgctctataacaccaacttcccacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagccctgttgccttcttacacaacaacagttgttgccgt

SEQ ID NO: 37717 - protein, 190 aa, Zea mays
  misc_feature: Ceres CLONE 1424174-F
  misc_feature (1)..(188): Pfam Name: Zein Pfam Description: Zein seed storage protein
MAAKIFCFLMLLGLSASAATATIFPQCSQAPIASFLPPYLSPAVSSVCENPILQPYRIQQAIAAGILPLSPLFLQQPSALLQQLPLVHLLAQNIKAQQLQQLVLGNLAAYSQQQQFLPFNQLAALNSAAYLQQQLPFSQLAAAYPQQFLPFNQLAALNSAAYLQQQQLPPFSQLADVSPVAFLHNNSCCR

SEQ ID NO: 37718 - DNA, 571 bp, Zea mays
  misc_feature: Ceres CLONE 1424187-F
  misc_feature (245)..(245): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
atagctggagctccccgcggtggcggccgctctagaactagtggatcccccgggctgcaggaattcgcacgagaccattacctagaacatcctaatcgaaaagacaccccctccgctctccttatcccttccattcgcccaaacccccgccgccgtgacccctgccagcccgcggccttccctcgttctaggcttcaactgccggcctcgtgtcttctgggcaagtgaagagagagatggcgtcnccaataccgcgcgagtgggtcggggctgcaaacaatttccctcccggccaccccgaaccgagttggacgaaagcgtcccccgggaaaaatcccaaaggggggggggggttgggggcccccctttggaaaaattttttttggggtttttgggggaaaaaaaaacccccaaagggggggaaaaaaaaaccccctcttttgtaacccccccccccgggggggggggaggaaggaaccccccccccgtggnnntcctttttttttctgggggcggggggggggggggaaaaaaaacaaaaaggggtggtggtgcggcctcccccccccct

SEQ ID NO: 37719 - DNA, 715 bp, Zea mays
  misc_feature: Ceres CLONE 1424188-F
  misc_feature: Encodes the peptide sequence at SEQ ID NO. 37720
ggcggccgctctagaactagtggatcccccgggctgcaggaattcgcacgagaccattacctagaacatcctaatcgaaagaactactccgtcactttgtttgcaaagctcctcctcgatccatcgatcacttcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgccaacacggcgcggcaggcgttccagcgcaccccggactacgtggaggaggcgcaccccaggatggctgatgccgcggcccacgcgggccaaaaaacgcgcaagcaggccaagccatccagggcaagggcgcaggaggcctgcgccggggggagtgcaggtgcaggc

SEQ ID NO: 37720 - protein, 177 aa, Zea mays
  misc_feature: Ceres CLONE 1424188-F
  misc_feature (44)..(161): Pfam Name: Oleosin Pfam Description: Oleosin
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCLANTARQAFQRTPDYVEEAHPRMADAAAHAGQKTRKQAKPSRARAQEACAGGSAGAG

SEQ ID NO: 37721 - DNA, 672 bp, Zea mays
  misc_feature: Ceres CLONE 1424190-F
  misc_feature: Encodes the peptide sequence at SEQ ID NO. 37722
gctccccgcggtggcggccgctctagaactagtggatcccccgggctgcaggaattcgcacgagaccattacctagaacatcctaatcgaaaaccgtcaggctgtcactgtccccctcaccgccgccgtcctcatcaccacacctcacccgttgctcccactccttccagaaccacctcctcgccaccgtggctgcctgccctgcccgctataagactcttcactcccgctgcgacgcagtcctcacaagcaccagaccaattaactagcttcttctagctctagctaggctcgtctgctgcaagaaggtaacagcgcacgcatggacgggaaggaagaggacgtccgcctgggcgccaacaagttctcagagcgccagcccatcggcacagcggcgcaaggcacagacgacaaggactacaaagagcccccgccggcgccactcttcgagcccggggagctcaagtcctggtccatctaccgcgccggcatcgccgagttcatcgccaccttcctcttcctctacatctccatcctcaccgtcatgggcgtctccaagtccacctccaagtgcgccaccgtcagcatccagggcatcgcctggtccttcagcagcatgatcttcgccctcgtctactgcaccgccggcatctccagcgggcacatcaaccc

SEQ ID NO: 37722 - protein, 116 aa, Zea mays
  misc_feature: Ceres CLONE 1424190-F
MDGKEEDVRLGANKFSERQPIGTAAQGTDDKDYKEPPPAPLFEPGELKSWSIYRAGIAEFIATFLFLYISILTVMGVSKSTSKCATVSIQGIAWSFSSMIFALVYCTAGISSGHIN

SEQ ID NO: 37723 - DNA, 718 bp, Zea mays
  misc_feature: Ceres CLONE 1424192-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (252)..(252): n is a, c, t, g, unknown, or other
  misc_feature (256)..(256): n is a, c, t, g, unknown, or other
  misc_feature (257)..(257): n is a, c, t, g, unknown, or other
  misc_feature (288)..(288): n is a, c, t, g, unknown, or other
  misc_feature (300)..(300): n is a, c, t, g, unknown, or other
  misc_feature (426)..(426): n is a, c, t, g, unknown, or other
  misc_feature (500)..(500): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctgggactccaccgncggnntggcggccgctctagaactagtggatccccncgggctgcaggnaattcgcacgagaccattacctagaacatcctaatcgaaaaatctattttacgggcggataaagacgggcggtaaatcctagtccatccaatcccgtcacgttcggcgaaacccggggtataaaancggagcacctcgcccccccctctaccaacaccgcagcggcagcacaatcgcctcgccttcccttccccaccagncccgtctctctcttcctctctgactctctctcttcgtaccgcggtccacctccgaagcaacaaaggcaaaggccgaccaaaatgggccccctcctaggaaaaacggggaaaattgctttcccccgggggggggtcccaaaaaacctggggggggggttcctttcggggaaaaaagttaaattaaattttttccccccaaagggggcgggggtttttcc

SEQ ID NO: 37724 - DNA, 705 bp, Zea mays
  misc_feature: Ceres CLONE 1424198-F
  misc_feature: Encodes the peptide sequence at SEQ ID NO. 37725
tggagctccccgcggtggcggccgctctagaactagtggatcccccgggctgcaggaattcgcacgagaccattacctagaacatcctaatcgaaaaatcacgcaatcgagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacgtactatccgtcagaggctctcaagcataatggctctttgtatgctcatgtttacttcgcccgttcgggttatcctgtggaccctacagatccagaatatgagcagaaatcttcgtttgggaggacccatcctgttgtggcattcttgccaaaatcaaaagctggtaaaaaga

SEQ ID NO: 37725 - protein, 171 aa, Zea mays
  misc_feature: Ceres CLONE 1424198-F
MSQPAATVAAAAQPQGRGPAGRQGGLGQSIAGIVRMAVFWYFASKFFGPKRPPADPGMLMSNLFQKGEPMDMWMYLSENEKFNDFANEDALIWHEANIPYAVWGPTSTRTRSLTYYPSEALKHNGSLYAHVYFARSGYPVDPTDPEYEQKSSFGRTHPVVAFLPKSKAGKK

SEQ ID NO: 37726 - DNA, 683 bp, Zea mays
  misc_feature: Ceres CLONE 1424201-F
aagctggagctccccgcggtggcggccgctctagaactagtggatcccccgggctgcaggaattcgcacgagaccattacctagaacatcctaatcgaaaatttttgcttggtttgcccgacacgtgcggtttgcgcgtcatatgtggctgcaagcactgccacccaggagtacgaaatcgtacggacggcgaaacggcaaacccaaactggccacgctcagcaagatgcacctaaaccctagcgccgtcgtccgacgccggcgtctcgttcatccggtggatcttccacgttcctgcggaagaggttatccacatcctgtctccagcgactctctcgtctgcgcctcgcgccggcgccgccatcccggtggtggagctctcggtgacgcggcgcgcggacctagcctacacgtcctccacgcagacggtaccaaggatttcgactagctgaacaaccacttcgtggacgaggaggaggagggcgaggcgctcctcgagagtgcggagatcgtctagttccccgaggaggcctacatggcgctcgactcccccaacgaggcgttccgagctgttctacgccttttagttgggcctcttgcccgccactgccgaccagctgcgccgatccactgttttttaaagggggatcccataccggcccgacctaaaaagaactcttcca

SEQ ID NO: 37727 - DNA, 601 bp, Zea mays
  misc_feature: Ceres CLONE 1424202-F
  misc_feature: Encodes the peptide sequence at SEQ ID NO. 37728
  misc_feature (351)..(351): n is a, c, t, g, unknown, or other
  misc_feature (359)..(359): n is a, c, t, g, unknown, or other
  misc_feature (383)..(383): n is a, c, t, g, unknown, or other
  misc_feature (543)..(543): n is a, c, t, g, unknown, or other
agctccccgcggtggcggccgctctagaactagtggatcccccgggctgcaggaattcgcacgagaccattacctagaacatcctaatcgaaaattcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattgcangaacatgntggcgccgctccctgtgctcaccntcatcatgtacatcatcgtcatcggcttcgcgagctggaacctgaaccactttcatcacgggcagaccaacttacccggcgtgggcgggcaccgcgcgacgttctactttctggtgtcgccatccttgccggcttggtgggccccgcgtccagctgggcnggcgttgcaccacgtgggcgcttgcgcccacaaaagcctgccaacaacgcccgggtct

SEQ ID NO: 37728 - protein, 82 aa, Zea mays
  misc_feature: Ceres CLONE 1424202-F
  misc_feature (2)..(2): Xaa is any aa, unknown, or other
  misc_feature (10)..(10): Xaa is any aa, unknown, or other
  misc_feature (63)..(63): Xaa is any aa, unknown, or other
MXAPLPVLTXIMYIIVIGFASWNLNHFHHGQTNLPGVGGHRATFYFLVSPSLPAWWAPRPAGXALHHVGACAHKSLPTTPGS

SEQ ID NO: 37729 - DNA, 699 bp, Zea mays
  misc_feature: Ceres CLONE 1424218-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (206)..(206): n is a, c, t, g, unknown, or other
  misc_feature (350)..(350): n is a, c, t, g, unknown, or other
  misc_feature (351)..(351): n is a, c, t, g, unknown, or other
  misc_feature (373)..(373): n is a, c, t, g, unknown, or other
  misc_feature (374)..(374): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactccaccgcggtggcggccgctctagaactagtggatcccccgggnctgcaggaattcgcacgagaccattacctagaacatcctaatcgaaaaatcggtctctccccatcccacctggcagttgccatctcgcaaagtcgcaataactttgtctctcgaatcggctgcaaacccacccagaacccacgnncgcgacgctagggtttgggggnntgagatcgcgatgtcgacggctccccagcgtccctttcggaggccggggggccatgccctcggggcaccggttacgtccccccggggcccggccccaggttccgccgaaaccccccaaaacccctggaaaaaccccgtttcccacccggtgaaaaaaattttcccccccaaaaaacaggggaaaccctctcaaaacccccggggattttgggtcccccacaccggcttctaaaaaaacccctctcaaaacctttggggggaacccccccgtttccaaaaaagaggttccctcgaaaaaaaaaaaaaggggggcgctctccccccc

SEQ ID NO: 37730 - DNA, 654 bp, Zea mays
  misc_feature: Ceres CLONE 1424224-F
  misc_feature: Encodes the peptide sequence at SEQ ID NO. 37731
  misc_feature (249)..(249): n is a, c, t, g, unknown, or other
  misc_feature (275)..(275): n is a, c, t, g, unknown, or other
  misc_feature (278)..(278): n is a, c, t, g, unknown, or other
  misc_feature (304)..(304): n is a, c, t, g, unknown, or other
  misc_feature (305)..(305): n is a, c, t, g, unknown, or other
  misc_feature (330)..(330): n is a, c, t, g, unknown, or other
  misc_feature (334)..(334): n is a, c, t, g, unknown, or other
  misc_feature (338)..(338): n is a, c, t, g, unknown, or other
  misc_feature (339)..(339): n is a, c, t, g, unknown, or other
  misc_feature (353)..(353): n is a, c, t, g, unknown, or other
aagctggagctccccgcggtggcggccgctctagaactagtggatcccccgggctgcaggaattcgcacgagaccattacctagaacatcctaatcgaaaaagccgtggatcgagtgcggagggggagaagcgtctatcccatgtcccgcgacggcggggaatagggcgacagctgcggcggggatcggctgcggcggctcgacgaggcggcggcggcggcgcgggtgggcggcggcaccatgtctgcngtagtctgtgggcagaggtcctcctnccnatctcacgacgagctcccctccgcanntccctactcccctcactcctcccancagncggnngcccaagagtcccngcggtcccccctcgcacgcgggcagctccgacggacaacgacggggagcgctcggtcaccatctggttttactcttccccgacatggattcccaggtgcctgaaaaaagtctggaagcatcttgggatgaccttggatccggcaataagagtttggaattggcaccccttaaaggcggcagaggcgatctgggcccctcccgggttccaaccgggaaaaatgggggcatactggcaatttccgcctcctcgttgagggagttcctaaaggggggggggggaaaccaccccccgaaaccctc

SEQ ID NO: 37731 - protein, 72 aa, Zea mays
  misc_feature: Ceres CLONE 1424224-F
MDSQVPEKSLEASWDDLGSGNKSLELAPLKGGRGDLGPSRVPTGKNGGILAISASSLREFLKGGGGNHPPKP

SEQ ID NO: 37732 - DNA, 647 bp, Zea mays
  misc_feature: Ceres CLONE 1424225-F
  misc_feature: Encodes the peptide sequence at SEQ ID NO. 37733
  misc_feature (520)..(520): n is a, c, t, g, unknown, or other
  misc_feature (565)..(565): n is a, c, t, g, unknown, or other
aagctggagctccccgcggtggcggccgctctagaactagtggatcccccgggctgcaggaattcgcacgagaccattacctagaacatcctaatcgaaaaacctaggactgggcacaacatgtctccatccgacgacggcgaggaaaccctcgccgcgctcatagaactgtctagaacgccggagggccgggagggtctcaccgacgtgctcatcgacaccctcttcctcctcccggcctccccgccgcgcctcttgctcctccgcctacgcctcctccgcaacctcctcgccggcgatgagctcaaccactacgccttcatcgagcactccggccccgccgccgtcgccgcctccgtgctctccttcccctcgctcgcccccgacgtggcgcgcgccgcgctccaggcgctcgggaacgccgcgctcgccggggagctccaccgcgacgccgtctggcaggcgctcttccctgaagcgctgcgggtgttcgcggggctcaaggaccagggagtcctgnatcccctgtgcatgggtctcgacacgtgctgcggcggggaaagcngtcccgggaagctcccagagctgtgtcacgaaaagctggggctgccaatccttctcccaactgtcactaccgcgttcacaag

SEQ ID NO: 37733 - protein, 175 aa, Zea mays
  misc_feature: Ceres CLONE 1424225-F
  misc_feature (134)..(134): Xaa is any aa, unknown, or other
  misc_feature (149)..(149): Xaa is any aa, unknown, or other
MSPSDDGEETLAALIELSRTPEGREGLTDVLIDTLFLLPASPPRLLLLRLRLLRNLLAGDELNHYAFIEHSGPAAVAASVLSFPSLAPDVARAALQALGNAALAGELHRDAVWQALFPEALRVFAGLKDQGVLXPLCMGLDTCCGGESXPGKLPELCHEKLGLPILLPTVTTAFT

SEQ ID NO: 37734 - DNA, 702 bp, Zea mays
  misc_feature: Ceres CLONE 1424228-F
  misc_feature: Encodes the peptide sequence at SEQ ID NO. 37735
  misc_feature (626)..(626): n is a, c, t, g, unknown, or other
  misc_feature (702)..(702): n is a, c, t, g, unknown, or other
ggagctccccgcggtggcggccgctctagaactagtggatcccccgggctgcaggaattcgcacgagaccattacctagaacatcctaattgaaaagtgggtcacagggaccaattataacaactgtcagatcactattgactcctcatcctatgaaagagctacgtgtgaagggtacatatcagcatcatagagaagtaaaggctgcgcaatgtatcaagataactgcacagggccttgaacacgccgttgctggtacttccttacatgtgattggacctgatgtggacgtggacgaagccaagaaaacagccatggaagatatgaagtcagtcatgagcttggttgacaaaagtggtgaaggagtttacgtacaagcttcaacgttaggatctttggaagcattactagagttcttgaagtcaccagatgtaaaaatacctgtaagtggtattggcctaggaccagtgcataaaaaggatatcatgaaggccggtgtaatgctagagaagaagaaagagtacgctacggttttggcttttgacgtgaagataactactgaggctcgcgaactagctgacaacatgggagtcaagatcctctccgctgatattatctatcatctngttgatcagttcaagggttatgtcaaggatgtccgagatgaagaaaggaagaaacagcatctgaagtagtgtttcn

SEQ ID NO: 37735 - protein, 180 aa, Zea mays
  misc_feature: Ceres CLONE 1424228-F
MKELRVKGTYQHHREVKAAQCIKITAQGLEHAVAGTSLHVIGPDVDVDEAKKTAMEDMKSVMSLVDKSGEGVYVQASTLGSLEALLEFLKSPDVKIPVSGIGLGPVHKKDIMKAGVMLEKKKEYATVLAFDVKITTEARELADNMGVKILSADIIYHLVDQFKGYVKDVRDEERKKQHLK

SEQ ID NO: 37736 - DNA, 718 bp, Zea mays
  misc_feature: Ceres CLONE 1424229-F
  misc_feature: Encodes the peptide sequence at SEQ ID NO. 37737
aaagctggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgctttttagaatgtatcttaatttattgtagaggttttatcttcacctttgactgagcaggt

SEQ ID NO: 37737 - protein, 118 aa, Zea mays; identical to SEQ ID NO: 12523
  misc_feature: Ceres CLONE 1424229-F
  misc_feature (13)..(116): Pfam Name: MAP1_LC3 Pfam Description: Microtubule associated protein 1A/1B, light chain 3

SEQ ID NO: 37738 - DNA, 684 bp, Zea mays
  misc_feature: Ceres CLONE 1424232-F
  misc_feature (235)..(235): n is a, c, t, g, unknown, or other
  misc_feature (285)..(285): n is a, c, t, g, unknown, or other
  misc_feature (292)..(292): n is a, c, t, g, unknown, or other
  misc_feature (454)..(454): n is a, c, t, g, unknown, or other
aaagctggagctccaccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcacccacggggtgcgacgggtaggtgcnggggctacggcgacttccagcgcgggggcagcatgcactgctaagcgcantcaccancagaagcagggcgcccatgatgactgcgcctccaggccacgacaggccgcgactttttggggggtcaatcctggtgcttttccgggcctgatccttggccgggacccggaattcccctctcccgtgggccaccccccggggctggtgatcctccacccgtgnttgttggcccccccccccacacccccttggggccctctggggggcccgggtttttcaccatccgggggggcttggggaacaaggggcggtcccggggtttccgggggggaaaaaaaaaccggagggggggaaacccccccccgggggcccaaccaccttggagaccccccacgggaggggatgggtgctcaaaggccccccgaatttttgagtgtgccaaacaaaccccc

SEQ ID NO: 37739 - DNA, 713 bp, Zea mays
  misc_feature: Ceres CLONE 1424234-F
  misc_feature: Encodes the peptide sequence at SEQ ID NO. 37740
  misc_feature (522)..(522): n is a, c, t, g, unknown, or other
aaagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttagggggagcatgcagatctttgtcaagaccttgactggggcagacatcacccttgaggtggagtcctcagacaccatttgacatgtcaaggcaangatccccagacaggaggggcatccaactgacaggaacgtcttatctttccgggaaagcattggagaatgggaggacccttgctgaatccaaatccaaaggggaggccccctcccttgggcgcgccttcagggggggatccaaaatttttggaaccccttgggggaaaacctcccccttgggggggggctcc

SEQ ID NO: 37740 - protein, 99 aa, Zea mays
  misc_feature: Ceres CLONE 1424234-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGSMQIFVKTLTGADITLEVESSDTI

SEQ ID NO: 37741 - DNA, 900 bp, Zea mays
  misc_feature: Ceres CLONE 1424240-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (336)..(336): n is a, c, t, g, unknown, or other
  misc_feature (340)..(340): n is a, c, t, g, unknown, or other
  misc_feature (341)..(341): n is a, c, t, g, unknown, or other
  misc_feature (372)..(372): n is a, c, t, g, unknown, or other
  misc_feature (521)..(521): n is a, c, t, g, unknown, or other
  misc_feature (529)..(529): n is a, c, t, g, unknown, or other
  misc_feature (530)..(530): n is a, c, t, g, unknown, or other
  misc_feature (592)..(592): n is a, c, t, g, unknown, or other
  misc_feature (779)..(779): n is a, c, t, g, unknown, or other
nnnnnnnnnnnnccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactggggactccaccncggnntggcggccgctctagaactagtggatccccncgggctgcaggaattcgcacgagaccattacctagaacatcctaatcgaaaactagaagccaccctgccgcctcaccgcctctctcactctgagaccgcagatccgttgtccggtgagtggaagcgcacgaaccatggcctcggcgagnctgctgcnnactacgcgctctcatcctcagcgacgatggcatcgccatcaccgccgagaagaacgccaccnatcgtgaaggcgggccaacaatcagggtcgaagtcctacttggccgggaactctttcgccaaaacttcctggaaaaaaccccaaccgtccaaggaacctccaccccccccccgttgggaaactggggggggggaaaactggcccccattttgggcggtgcccccaccccggcgtggggggggggttngggaaaattttttttcccccccccggtgtgtgggggaaaaaaaaaaaaaaaaaaaagcccccaggggagagttcctaaaaaaaaccaaagggggttctaccccgtgtgtccaaaaaaaaaa

SEQ ID NO: 37742 - DNA, 587 bp, Zea mays
  misc_feature: Ceres CLONE 1424243-F
  misc_feature: Encodes the peptide sequence at SEQ ID NO. 37743
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (197)..(197): n is a, c, t, g, unknown, or other
  misc_feature (231)..(231): n is a, c, t, g, unknown, or other
  misc_feature (363)..(363): n is a, c, t, g, unknown, or other
  misc_feature (369)..(369): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnccaagctgggactccccncggtggcggccgctctagaactagtggatccccncgggctgcaggaattccacgagaccattacctagaacatcctaatcgaaaaaaaccgagcggacgccgccatggatcgcgagtggggctccaagcccggcagcggcggcgccgcctccgcgcagaatgaggnccatcngaccggcggggagcgccctcgccgccttggccctcgagaacatcgacctcgcaaggacccctatttcatgcgcaaaccaccctcgcagctacaaatgcaaactgtgcctgacccttcccaacaattggagggggaaaatcccctggcccccacccccggggggaaaagggcccccaaaacaaaccttccccaaaaggccgcccccccccccccagagg

SEQ ID NO: 37743 - protein, 95 aa, Zea mays
  misc_feature: Ceres CLONE 1424243-F
  misc_feature (21)..(21): Xaa is any aa, unknown, or other
  misc_feature (23)..(23): Xaa is any aa, unknown, or other
MDREWGSKPGSGGAASAQNEXHXTGGERPRRLGPREHRPRKDPYFMRKPPSQLQMQTVPDPSQQLEGENPLAPTPGGKRAPKTNLPQKAAPPPPE

SEQ ID NO: 37744 - DNA, 650 bp, Zea mays
  misc_feature: Ceres CLONE 1424251-F
  misc_feature: Translation starting site: 139
tggagctccccgcggtggcggccgctctagaactagtggatcccccgggctgcaggaattcgcacgagaccattacctagaacatcctaatcgaaaaagatcgggccatcggggaggcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaaggagatggaggaggaagccgccgcccctcgcgatatgcaggccaaggtcgccaaggagattgcagggagtgaccctagtgcatctacagctgaagcaaaggagcaggtggatgccccgtctgtgtatgttggaaattgtggattatgcttgcaccccagaaggagtggcacagcatttcccagccttgtggaactgtccacagggtgaccatcttgactgacaaagttggacaggcaaaaagtttttgcttatgttggaattctggaacaggaaagggttcaggaaactctttaacctggatggatctggaatgcctgggccccccaaattagggccgcccaaagaagaacttatgttcctgggattaacca

SEQ ID NO: 37745 - DNA, 637 bp, Zea mays
  misc_feature: Ceres CLONE 1424266-F
  misc_feature: Encodes the peptide sequence at SEQ ID NO. 37746
agctccccgcggtggcggccgctctagaactagtggatcccccgggctgcaggaattcgcacgagaccattacctagaacatcctaatcgaaaactttcctttccctacggcggcggcgctggagcagctaagcagcagcaagatgttcgacggcttcaatctccgcttccgccgccagagcgccacccttggctgcgccatgactttctccatctacctgcccccgtccccggtgtccaaccttcccgtgttgtactggctctcgggtctcacctgcaccgaggataatttcatcataaagtccggcgcccagcacgccgccgctgcccacggcatcgccctcgtggcacctgacacctccccacttatcttctgcatgatggattcatttgatggaactattttaggcctctgattgcggaatacagatcgatttgcttgtcacaaggataaagcagatccacgatgagtagaagcgtgggcatccaaatgaataaccaggggagagcagtctaaggcaaatttgctaggctggagcagtcacaagagctagggactacagtcataggtcctgctagccagggtggagcagtcataagacctcctagcagtccaaggcaaatttgctaggtggga

SEQ ID NO: 37746 - protein, 90 aa, Zea mays; identical to SEQ ID NO: 18079
  misc_feature: Ceres CLONE 1424266-F
  misc_feature: SWISSPROT Homolog: EC 3.1.2.12 S-formylglutathione hydrolase

SEQ ID NO: 37747 - DNA, 715 bp, Zea mays
  misc_feature: Ceres CLONE 1424274-F
  misc_feature: Encodes the peptide sequence at SEQ ID NO. 37748
ggagctccccgcggtggcggccgctctagaactagtggatcccccgggctgcaggaattcgcacgagaccattacctagaacatcctaatcgaaaaataatttgtctctcgtgcctcgttgcgtctttgtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaagaactgtgggaaggtcaaggctggcggtgcttacaccatgaacactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagatctgtagttggttaccgttttgaatttctcaagtgatattatcctatgcttgtctcaatgactcaaatttggttgtggtttctatgctaaacaaaaaaaaaaaaagcttatcgataccgtcgacctcgagg

SEQ ID NO: 37748 - protein, 92 aa, Zea mays
  misc_feature: Ceres CLONE 1424274-F
  misc_feature (2)..(91): Pfam Name: Ribosomal_L37ae Pfam Description: Ribosomal L37ae protein family
MTKRTKKAGIVGKYGTRYGASLRKQIKKMEVSQHSKYFCEFCGKFAVKRKAVGIWGCKNCGKVKAGGAYTMNTASAVTVRSTIRRLREQTEA

SEQ ID NO: 37749 - DNA, 629 bp, Zea mays
  misc_feature: Ceres CLONE 1424275-F
  misc_feature: Encodes the peptide sequence at SEQ ID NO. 37750
aaagctggagctccccgcggtggcggccgctctagaactagtggatcccccgggctgcaggaattcgcacgagaccattacctagaacatcctaatcgaaaagcctagcggtgacatcgtcccctcgactcctcctccatccccgacgcggcggcgccagcctgcaggttgttgatgcaccaatgctgcctaccaaattcctctgtcttaagcacctgaccgttcgcttgtcatcaggaacaaccattacccaggcatttgactatttctctttggtttctttccttgatgcgtctccttccttggagacttttatattaaatgtgagtgggaaaggcatgatccatgaatcgatttctgcacatccacaattgaggcacacacctgagcaccaccatggccacctcaggagtgtgaagatatgtggtttcagctctgagaaaagcttatttgaactaacacgttatattcttgagaatgcggtgtcactgaaatttcttacactggacaccttttatgggtatcggtgtggtcagggtaagtgtacaagttgtttacccacgcctgatgtttttatggatgtttccaaagcgatctcaggtatcaagacatacatcgagaacaaagtt

SEQ ID NO: 37750 - protein, 149 aa, Zea mays
  misc_feature: Ceres CLONE 1424275-F
MLPTKFLCLKHLTVRLSSGTTITQAFDYFSLVSFLDASPSLETFILNVSGKGMIHESISAHPQLRHTPEHHHGHLRSVKICGFSSEKSLFELTRYILENAVSLKFLTLDTFYGYRCGQGKCTSCLPTPDVFMDVSKAISGIKTYIENKV

SEQ ID NO: 37751 - DNA, 660 bp, Zea mays
  misc_feature: Ceres CLONE 1424284-F
  misc_feature: Translation starting site: 172
  misc_feature (399)..(399): n is a, c, t, g, unknown, or other
aaaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttacctttgttcccccataacttgcatcaattatagcttcagtatgtgaaaacccagctctgcaaccatatatggcttcaacagcaatcgcagcaagcaacataactatatcgccgtttgtgatgtcacnatcgacagccctatctttggtggcaatcattggcaccaaacatcagggcacaacagctgcaacaactcgtggctaccgggtatcagccagtaagctctgggcaaacctttgtccctaccctcaaggaacaaccaatttcttcatttctaccaaatggcttccatggaaccctgccgggttaatggcggcaacaatttttaccattttaggcaggttggctactgggctatctccaaagaaaaaaactttctccatttacac

SEQ ID NO: 37752 - DNA, 670 bp, Zea mays
  misc_feature: Ceres CLONE 1424300-F
  misc_feature: Encodes the peptide sequence at SEQ ID NO. 37753
aaagctggagctccccgcggtggcggccgctctagaactagtggatcccccgggctgcaggaattcgcacgagaccattacctagaacatcctaatcgaaaaacaaataggcggcagctcagcgccacccctccggtcccgccgagttcggagcgcatcgcagggcggggaggaggagcaagaagccgccggcctccctccgccggctcaccaccgggcttactccgcaccacgctgcctcgggtcggagcggcatcaaaatccggatgcccaggctgcttcggacccgagggtgatccctggctattatcaaacaaaagtggtggcacttgatggcggagatgactgctaggagcaagaacagcatattacacctggacaataagcagggctggcctcttcagctaccaaagctccggttcccttggaatacacatgaagacaacggtcttactctctgactctgccacgatctggaccttctcatggctgcctgtttgctagcatgggtcttaggtggtcaacaggtggcccactcctggcgcccggaccgggtgactcggatattaagattgcattcactgatcattcgatgacgcacgtgtctgaggcaggtgcgtaccaggttattactactgagcactatccctggtatgatgtccgtggatgc

SEQ ID NO: 37753 - protein, 42 aa, Zea mays
  misc_feature: Ceres CLONE 1424300-F
MAEMTARSKNSILHLDNKQGWPLQLPKLRFPWNTHEDNGLTL

SEQ ID NO: 37754 - DNA, 663 bp, Zea mays
  misc_feature: Ceres CLONE 1424314-F
  misc_feature: Translation starting site: 186
  misc_feature (406)..(406): n is a, c, t, g, unknown, or other
  misc_feature (452)..(452): n is a, c, t, g, unknown, or other
aagctggagctccccgcggtggcggccgctctagaactagtggatcccccgggctgcaggaattcgcacgagaccattacctagaacatcctaatcgaaaaaccaaattaaaccgccggcgcctccacttcgcgttctcgcctcatctcctcccgctcaggatccggcggcgaaggtaaggcaagatgtacaccgcgaggaagaagatccagaaggataagggccttgagccctccgagttcgaggactccgtcgcccaggctttcttcgacctggagaacggtaaccaggagctcaagagcgacctcaaggacctttacatcaacggtgctatccagctggatgttgccgggagcaggaaggctgttgtgatccacgtcccataccgctttgcgtagggcttcangaagatccatgtcaggatcgtcagggagcctggaaaagaaattcancggcaaggatgtggtatttggtgccacaaggaggatcgtgaagcccccccagaaggggtccactttgttagccccctcccaccaggacttggaatggttgcccagaagggccccccgggaaaaatttcctttccccccttaaaatttgggggaaccgttcccggacccccctgggggggggccaaaaaaaaaaaatttttttgggaccaaa

SEQ ID NO: 37755 - DNA, 716 bp, Zea mays
  misc_feature: Ceres CLONE 1424315-F
  misc_feature: Translation starting site: 201
  misc_feature (617)..(617): n is a, c, t, g, unknown, or other
  misc_feature (618)..(618): n is a, c, t, g, unknown, or other
  misc_feature (633)..(633): n is a, c, t, g, unknown, or other
  misc_feature (702)..(702): n is a, c, t, g, unknown, or other
  misc_feature (707)..(707): n is a, c, t, g, unknown, or other
  misc_feature (716)..(716): n is a, c, t, g, unknown, or other
aaagctggagctccccgcggtggcggccgctctagatctagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttccctgctcgcttctcgacgggcgggcaggccacgggcacctttcggctgaacggcgtgtcnngtgtgggaagcgctnggtgctgaaatcgtgatgaccttcgggctggtgtacacggtgtacgccacggcggtggacccgaagaanggcancctgggcan

SEQ ID NO: 37756 - DNA, 709 bp, Zea mays
  misc_feature: Ceres CLONE 1424316-F
  misc_feature: Translation starting site: 145
  misc_feature (225)..(225): n is a, c, t, g, unknown, or other
  misc_feature (233)..(233): n is a, c, t, g, unknown, or other
  misc_feature (243)..(243): n is a, c, t, g, unknown, or other
  misc_feature (276)..(276): n is a, c, t, g, unknown, or other
  misc_feature (299)..(299): n is a, c, t, g, unknown, or other
  misc_feature (300)..(300): n is a, c, t, g, unknown, or other
  misc_feature (303)..(303): n is a, c, t, g, unknown, or other
  misc_feature (307)..(307): n is a, c, t, g, unknown, or other
  misc_feature (308)..(308): n is a, c, t, g, unknown, or other
  misc_feature (326)..(326): n is a, c, t, g, unknown, or other
  misc_feature (373)..(373): n is a, c, t, g, unknown, or other
gcccgaaggtgccctagaccattacctagaacatcctaatcgaaaaaccaccgcatcccacaacccccgagctcagcttagctccactccagctccaatcgcactcgtgaccagagcgcgagagctagctagagggccgtgaaaatgccgatcaataggatcgccctggggagccaccaggaggtgtaccacccgggcgacttcaagggggcgttggttgagttnatttccancttaattttngtttttcttcggcagggtttcaggatggacttnattaagataaaaggggggggtcnnatnactnngatgtgtttgatcttggntaagagggagaacaccctccccctctctcccccacaagacaacgcgnggtaaacatctccgggggaaaaacgaaactcttgttttgaacttttggcgaatttaataggaagagaaactcccccccgtgttcggggcgccaccaggcactgggttgggggaaattggtgggggaaccaccagagagcgggctacgctgcccccgcttcccccccgggggggtgaaggcccaccgcccctttctccggcccactgagggggtcccccacgacaaaaccccctctcgctgcataacccccacctccccccttcgcattggcttccccggggatccccccaccgccgcgggccccccacacaaagccgggttgcggggccctcttcc

SEQ ID NO: 37757 - DNA, 632 bp, Zea mays
  misc_feature: Ceres CLONE 1424323-F
  misc_feature: Encodes the peptide sequence at SEQ ID NO. 37758
tccccgcggtggcggccgctctataactagtggatcccccgggctgcaggaattcgcacgagaccattacctagaacatcctaatcgaaaaaattcacgcccccaccacgacttccgtgctcgccgccttctcggactaggggggttcggctcgagatctgatttcgggcgccggaggactacatggaggttagggagatggcgatggccgcggcggctgccgctgctgcgtccggcgggggaggcgtcaagctgccgccgcccaatcccaacctgccctacagggaggactgctggagcgacggcaagacagcatctctcgtctccgcctggggcagccgctacgtctagctcaaccgcgctaacctgcgccagaagcactggcaggaggtggccgacgccgtccactcgcgccggggagcctccgcgcggcgccgcccgccgcgcaccgacatccagtgcaagaaccgcgtcgataccctcaagaaaaagtacaaggccgagctcgcccgcaacgcgccgtccgcctggtcctacttccccgagctcgactcgctcgtcggcccaacctcagcgcctcggcctctagagacctttggcgtctctgcctcctaattccctttgcccatgca

SEQ ID NO: 37758 - protein, 55 aa, Zea mays
  misc_feature: Ceres CLONE 1424323-F
MEVREMAMAAAAAAAASGGGGVKLPPPNPNLPYREDCWSDGKTASLVSAWGSRYV

SEQ ID NO: 37759 - DNA, 848 bp, Zea mays
  misc_feature: Ceres CLONE 1424338-F
  misc_feature: Encodes the peptide sequence at SEQ ID NO. 37760
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (265)..(265): n is a, c, t, g, unknown, or other
  misc_feature (269)..(269): n is a, c, t, g, unknown, or other
  misc_feature (270)..(270): n is a, c, t, g, unknown, or other
  misc_feature (510)..(510): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaactggaactccccncggnntggcggccgctctagaactagtggatcccccgggctgcaggaattcgcacgagaccattacctagaacatcctaatcgaaaaggaggtaggagaggagggaggggaaaagagagatggtggaggcatcgccggagtcaggcgccgcggcgaccggaggtgcctctagtacggcggcggtgcggaaagggaagtcatgcaagggctgcctctactactcgtcagtgctcaagtcccgcggntacaacccaatctgcggtgggatcccccgctccatccccccagttcctaactaccttgtggaatgaccttaagaggaagccgacggccccaggggcatgacctcaggcggttcacaggaccggtgggccgggttaacccccagtttctggaaacaaaaggaaccggcaagggtgtgtaaaaaccaaggcaaaaaaatttttttccccatttttcagggggcccccaaatattttgtgggaaaaacaaaattggttcaaaaaaaaaaacctcttgggaaatagaaaaaaactcccccacaattttgttaaaaaaaaacaagcgtttcccaactcccttt

SEQ ID NO: 37760 - protein, 63 aa, Zea mays
  misc_feature: Ceres CLONE 1424338-F
MVEASPESGAAATGGASSTAAVRKGKSCKGCLYYSSVLKSRGYNPICGGIPRSIPPVPNYLVE

SEQ ID NO: 37761 - DNA, 654 bp, Zea mays
  misc_feature: Ceres CLONE 1424345-F
  misc_feature (364)..(364): n is a, c, t, g, unknown, or other
  misc_feature (366)..(366): n is a, c, t, g, unknown, or other
aagctggagctccccgcggtggcggccgctctagaactagtggatcccccgggctgcaggaattcgcacgagaccattacctagaacatcctaatcgaaaagtgcaggtgacggcgaaccaggtaaccagctgccgagggaggaaccctagcggaacactgtgcaggtgacggcggcgcgctaccggtgacgggggatacggcggcatcgtccccctcggcccctcctccatccccggcgtggcggcgcaggcagccagcctgcagggttttctgactcagattacttgttcactgtggggtgcaagcttaatcggccaccatggatgttgataagcaagaaacaatggaggagaccatccttngntggtgatgatctcatgcgtgggccgccatcccctgtcataccgaaagagatcgcatcacatggtccttgaaggatgtgagctttgtgatggtatactcaaagaactttttcttatgcctacagatcaatggatttggagcctttctgccaagatgaattgggcttattcgaacgggggcctggaaaaagggaacaggaaattaaagggcggatgcaaaaaggggaataaaattggggtttttcaaagccccggaaaacaaggagagggagagggcttcccccctcccc

SEQ ID NO: 37762 - DNA, 646 bp, Zea mays
  misc_feature: Ceres CLONE 1424361-F
  misc_feature: Encodes the peptide sequence at SEQ ID NO. 37763
aaagctggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggtgatggaactacaactgcctctgttctcgctagggagatcatcaaattgggcatgttgagcattacttcaggggcaaatccagtgtccgtt

SEQ ID NO: 37763 - protein, 161 aa, Zea mays; identical to SEQ ID NO: 35926
  misc_feature: Ceres CLONE 1424361-F

SEQ ID NO: 37764 - DNA, 654 bp, Zea mays
  misc_feature: Ceres CLONE 1424367-F
  misc_feature: Encodes the peptide sequence at SEQ ID NO. 37765
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaaaatctctctcttctcctcgcctcgccttggtgttaacgccgacgctagcgcctggcgcggcgagacttctgccctccccggcgccaggctcgggtcgtcgacggccatccagctgctacggcatgaacacggtcacaccattacggcagaaccacgcgacgtgaacggagaactcttgaagaacaaagccgccactgaggaaaccctagcgacggcggcgtgctaccggtgacattgtccccgtcgggccctccatccctgacgcagcggcgccagactgcaggaagccagcccctattcgagacaaggtcgatctttgctgccttggcgagcttcagccgaatcaaggtcgagcatggaggcaggccagtaaatagagcaacacaaaacccttctaattgatggagacctctgcagcaaccacgacccggccgccacaacaggcggtcacttccccatcgccatcgccctcgtcatcgctgaagctgtggaagccgacggcgcatcgcatcatgcgcaatcagtgatcccatctgagcgtctccnacgagc

SEQ ID NO: 37765 - protein, 41 aa, Zea mays
  misc_feature: Ceres CLONE 1424367-F
METSAATTTRPPQQAVTSPSPSPSSSLKLWKPTAHRIMRNQ

SEQ ID NO: 37766 - DNA, 642 bp, Zea mays
  misc_feature: Ceres CLONE 1424368-F
  misc_feature: Encodes the peptide sequence at SEQ ID NO. 37767
aaagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcaccatcaccgcgccgcccggggagcagaccacgggaacgtccaaggtgctggacatgggcgcggcggtcatgcagtcgttgcgccccgtgaagcaggcaaatcatcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatctgcgtggagtacatcgtgacgaggaagatcttcgactctctgccggcggatgagcagcggctgtggcactcgcacgcgcacgagatcaagtcaggcctgtggaccaacccgcacgtggcggggctgctggagaaggctgagctggaccacatggccgccacgttcggcaagttctggtgcacctggg

SEQ ID NO: 37767 - protein, 162 aa, Zea mays
  misc_feature: Ceres CLONE 1424368-F
  misc_feature (26)..(162): Pfam Name: DUF1264 Pfam Description: Protein of unknown function (DUF1264)
MASSDGKPLPTPASVGGGGGTITAPPGEQTTGTSKVLDMGAAVMQSLRPVKQANHHMCTFALYAHDPKRQVETHHYVSRLNQDFLQCAVYDSDKADARLICVEYIVTRKIFDSLPADEQRLWHSHAHEIKSGLWTNPHVAGLLEKAELDHMAATFGKFWCTW

SEQ ID NO: 37768 - DNA, 872 bp, Zea mays
  misc_feature: Ceres CLONE 1424372-R
gaattgggtaccgggccccccctcgaggactagcgtgctataaggtagatcgaggaccatcctcgactaccctggaagacggcactgcaatgcactgcagtctacagaactcgtcagtctcagatccgtgcaagcggtctgcacctgcatcgcctaaccaagtcctcaattagtctgctgttgccatttgcgaggcaagccacctgctatctttttgcaggaaccactaaacgtgtaccaagtcttcttgcgcgggggcggaggcaggctccgtcagtctcgccgggggcatacagatcatggaggactttggccgctggaatatgcagtatgcagcatagctatgcctgccaagccggcgggacgactacgacgacaactactgcctcctcggtgacttcctaggaggctgcggtctggacctccgttctgacaatggcggcctcaacctgacctcttcgcaccctgctgtacataaccttgtgccctgcctcattggcgcgagtctttccgtttccgacgccttcgtgggcctggatcactgggatttgctctctagcgtcactggtgcatctggaatgcagagtcctcataacctgttccttgcggactataaaccccgtcgacgtcaccgccgcagaggaccggcttcgcagtccaccggcttcgagacagctccttttgcgggataacatgagaaaccgcgggcggggaaataaccccaaacattttccatccagaaaaattcctaaagctttagggccgggaggcggaatataatgccattaacatagggaaagtttgtgtatgtccgaaataaagggcctcagaaaacaggaaagaataggccccactcatttcacgctctcaat

SEQ ID NO: 37769 - DNA, 635 bp, Zea mays
  misc_feature: Ceres CLONE 1424380-F
  misc_feature: Encodes the peptide sequence at SEQ ID NO. 37770
  misc_feature (487)..(487): n is a, c, t, g, unknown, or other
  misc_feature (501)..(501): n is a, c, t, g, unknown, or other
  misc_feature (502)..(502): n is a, c, t, g, unknown, or other
  misc_feature (537)..(537): n is a, c, t, g, unknown, or other
  misc_feature (575)..(575): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (589)..(589): n is a, c, t, g, unknown, or other
  misc_feature (590)..(590): n is a, c, t, g, unknown, or other
  misc_feature (597)..(597): n is a, c, t, g, unknown, or other
ggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcgggcctcgccacgccgncccgaatggctaannaattggggttaaccccaaccccacaacccacaaanggggaggggcgccccgcccccgtcttttattttttaantggcnnnncgcggnntgggggnggggggtcccccccccccaagggggggggggggggggc

SEQ ID NO: 37770 - protein, 116 aa, Zea mays
  misc_feature: Ceres CLONE 1424380-F
  misc_feature (41)..(113): Pfam Name: Tryp_alpha_amyl Pfam Description: Protease inhibitor/seed storage/LTP family
  misc_feature (113)..(113): Xaa is any aa, unknown, or other
MAATSSKSSSSSSSAQRAAAALLVAAAVAVSVLVVGAAAVCDMSNEQFMSCQPAAAKTTDPPAAPSQACCDALAGADLKCLCGYKNSPWMGVYNIDPKRAMELPAKCGPRHAXPNG

SEQ ID NO: 37771 - DNA, 646 bp, Zea mays
  misc_feature: Ceres CLONE 1424385-F
  misc_feature: Encodes the peptide sequence at SEQ ID NO. 37772
tggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctggaagctccagttgttgttgttacaggtgcctctagagggattggaaaggcaactgctctagcccttggaaaagcaggatgcaaggttctggtaaattatgctcggtcttcgaaagaggctgaagaggtctccaaagagattgaagcatctggtggtgaggctatcacctttggaggagatgtttcaaaagaagctgatgtagagtctatgatgaaagcagctctagataaat

SEQ ID NO: 37772 - protein, 147 aa, Zea mays
  misc_feature: Ceres CLONE 1424385-F
  misc_feature: SWISSPROT Homolog: EC 1.1.1.100 3-oxoacyl-[acyl-carrier-protein] reductase
MAAAAAAAAAVSSPIAPRAVAAAASRRGFVTFGGGAARSSPTLRSGRGFSGVQTHVAAVEQAVVKDATKLEAPVVVVTGASRGIGKATALALGKAGCKVLVNYARSSKEAEEVSKEIEASGGEAITFGGDVSKEADVESMMKAALDK

SEQ ID NO: 37773 - DNA, 659 bp, Zea mays
  misc_feature: Ceres CLONE 1424389-F
  misc_feature: Encodes the peptide sequence at SEQ ID NO. 37774
aagctggagctccccgcggtggcggccgctctagaactagtggatcccccgggctgcaggaattcgcacgagaccattacctagaacatcctaatcgaaaagtcacccacgagcccaacaaaccactcccacccggtggctcgtcctcggacgccaagccactccgcgccccaatccggaagcgccgccgccgccgatcgaccggtcgtcgacccatgctccgctcggcgctcttccgctcagcccccgggctccgccggtctccggcgacggcccacttatccaccgccgccgccaccgccgcagcgtggctctccaacggccctgcctccgccccgactagggtgcgcctcctcatcggcggggagttcgtcgagtcgcgcgccgacgagcacgtcgacgtcaccaaccccgcgacgcaggaggtggtgtcccggatcccgctcaccacggccgatgagttcaaagctgccgtcgatgccgccaggacggccttccccggttgggggaacacgcccgtcacgacgcgacagcgcgtcatgttaaagttccaggagctcatccgggctaacatggacaagcttgcacataacatcactaccgagcaggggaagactctaaatgatgcttggggcgacgtgctccgcggcctataggtg

SEQ ID NO: 37774 - protein, 146 aa, Zea mays
  misc_feature: Ceres CLONE 1424389-F
  misc_feature: SWISSPROT Homolog: EC 1.2.1.27 Methylmalonate-semialdehyde dehydrogenase (acylating)
MLRSALFRSAPGLRRSPATAHLSTAAATAAAWLSNGPASAPTRVRLLIGGEFVESRADEHVDVTNPATQEVVSRIPLTTADEFKAAVDAARTAFPGWGNTPVTTRQRVMLKFQELIRANMDKLAHNITTEQGKTLNDAWGDVLRGL

SEQ ID NO: 37775 - DNA, 643 bp, Zea mays
  misc_feature: Ceres CLONE 1424396-F
ggagctccccgcggtggcggccgctctagaactagtggatcccccgggctgcaggaattcgcacgagaccattacctagaacatcctaatcgaaaaaatagttcggtgcctttttctagcggggaggaggcaggcggcgcgatctggcaccggccatcacgttccctcccgccgcttccccctccctgccctcccgttccccagatctgaagccattaaaaccagcggatctcacctcggggcgcgtccgcggcatctgggcaagcgagtggtagagccagcagccatgagatggtatgcatcggtagcctcctgagggcgctggtcctgagtgcggcggcgtctgcgggcaggcgccgggggcccaggatcctgtgtggccacgaggcggatgtacgcgtgactcctcggcacggacacggctggcgcggattccgggcagtcacgggaaggatgatgctggactcctctgactgtgcctctgctgccgccgccgcggaagccggggcaggtgcagccgcagcgccgcgcggtggggggcgtgcccctggcgcacgacgggggctaccccaacggggaaatggaaaaaaaaatagcaaactaaattgggaaaccccagtttttagggcaaaaaactctcaag

SEQ ID NO: 37776 - DNA, 662 bp, Zea mays
  misc_feature: Ceres CLONE 1424397-F
  misc_feature (355)..(355): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaatcccctctcatccttatcttggcggcggcgcaagcgcaggcgagcggccgtccagtcgcgcgggcagcaggggcggccgtccgtccaggcgcaggcgagcggccgtccgtccagcgcaggctagcggccatccgtccaggcgaactgcgagcaggcgtccctccaaacgaactgcgagcgtccgtccaggcttccgtccagcgagcggcacaacttttctacgcacacacattccaagaaccgaaaaatganagtgaaagagctggtgagcacttttgtggaacagttgatggtaatgggcatgttgtgtggactttctgcaatgtccgcttacatgctctagtacctanccaggcctgtggcttgaagggtcacgacatccaccagctttcgaaaagttcaccttaacatgtgtgcttaagctctaaatgactatttctaagatgaaactcactgggggaaacagtggagaaaccttttgaggacatgggaaagaaaatatttccaagatatacccgacttagggaagttaatgcctgctttcttgaaacgcaaataa

SEQ ID NO: 37777 - DNA, 610 bp, Zea mays
  misc_feature: Ceres CLONE 1424400-F
  misc_feature: Encodes the peptide sequence at SEQ ID NO. 37778
aagctggagctccccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccataggcgacaccgtccccaacctggagctggactccacccacgggaagatccgcatccacgactacgttggcgacggctacgccatcatcttctctcacccagccgacttcacgcccgtgtgcaccacggacatggcggcgatggcggggtacgccaaggagttcaagaagcgtggcgtgaagctgctgggcatctcgtgcgacgacttggaatcgcacaggcagtggaccaaggacttggaggcgtacggcgggaagcatcagcaccatcagcatacgacgaacgaaggtgacgcttcccgatcctggacagaccccgggggaggggacctcccttttcggccaatttaaaaaaagggggggaacccccccaaaaaaaaaaaaaactgtgggggggaaaaaaaaaaaaaaaccggggggccccaattttggggggaaaaaagg

SEQ ID NO: 37778 - protein, 121 aa, Zea mays
  misc_feature: Ceres CLONE 1424400-F
  misc_feature (6)..(119): Pfam Name: AhpC-TSA Pfam Description: AhpC/TSA family
  misc_feature: SWISSPROT Homolog: EC 1.11.1.15 Peroxiredoxin
MPGLTIGDTVPNLELDSTHGKIRIHDYVGDGYAIIFSHPADFTPVCTTDMAAMAGYAKEFKKRGVKLLGISCDDLESHRQWTKDLEAYGGKHQHHQHTTNEGDASRSWTDPGGGDLPFRPI

SEQ ID NO: 37779 - DNA, 635 bp, Zea mays
  misc_feature: Ceres CLONE 1424402-F
  misc_feature: Encodes the peptide sequence at SEQ ID NO. 37780
aagctggagctccccgcggtggcggccgctctagaactagtggatcccccgggctgcaggaattcgcacgagaccattacctagaacatcctaatcgaaaaagccgcatcccttctttcattccccgcctccgcctgctctctgctgccgtccccatggggagaaggcctgcaagatgctatcgccagatcaagaacaagcacataccccaagtccacgaactgccgtggtgtccctgaccccaacatcaggatctacgatgttggcatgaagaaaaagggtgttgatgagatccccgactgcgtgcaccttgtctcttgggagaaagagaatgtcaccagcgaggctcttgaggctgcccttattgcctgcaacaagtacaggaccaagtctgcacgaaaggatgccttccaccttcgggtccgggttcaccccttccatgtccttcgtatcaacaagatgctttcttgtgctggggctgataggctccacactggaatgaggggtgcctttggcaagcctcacggcacctgtgctagggaggacattggtcaggtcctcctttctgctcaatgcatggacaacaatgctgcacatgccagtgaaactctgcgtcacgccaagtacaagtccct

SEQ ID NO: 37780 - protein, 122 aa, Zea mays
  misc_feature: Ceres CLONE 1424402-F
  misc_feature (2)..(122): Pfam Name: Ribosomal_L16 Pfam Description: Ribosomal protein L16
MKKKGVDEIPDCVHLVSWEKENVTSEALEAALIACNKYRTKSARKDAFHLRVRVHPFHVLRINKMLSCAGADRLHTGMRGAFGKPHGTCAREDIGQVLLSAQCMDNNAAHASETLRHAKYKS

SEQ ID NO: 37781 - DNA, 648 bp, Zea mays
  misc_feature: Ceres CLONE 1424404-F
  misc_feature: Encodes the peptide sequence at SEQ ID NO. 37782
aaactggagctccccgcggtggcggccgctctagaactagtggatcccccgggctgcaggaattcgcacgagaccattacctagaacatcctaatcgaaaaatgatcttcgcccctcgcgcttaccgctgccacgcctcccgacttgcctcctccgcctagttccgggctctccaatggcctccatgttcgcgatcctcaggccctccgagccggccccgctcgcggggcgcctggccagggctgccgcgcccgcgaccgctagggtggcgctagctacaacatctaggtattcgacggtcagggtgtcgctcggctccgaggttgcagtgggcgacgacgcgctcttctccgactataagcccaccaccgctttcctcgtccgcggacagagtgccacaaccgttggaatgcgggcacaaactcagagtgtatccgcatctaccaaattgctcaaccagtgaaatgacatccttgcgaatgactcgctggatcattgcaccgatggaccgagaaagaagcttgactcaccaatgatctgtcagccgtatatctatgtcaccagacttgctacactagacgtactacgtgaacactatggaggccacgatgtcgataactctgtagatgttacatgagggctcagctt

SEQ ID NO: 37782 - protein, 95 aa, Zea mays
  misc_feature: Ceres CLONE 1424404-F
MASMFAILRPSEPAPLAGRLARAAAPATARVALATTSRYSTVRVSLGSEVAVGDDALFSDYKPTTAFLVRGQSATTVGMRAQTQSVSASTKLLNQ

SEQ ID NO: 37783 - DNA, 623 bp, Zea mays
  misc_feature: Ceres CLONE 1424407-F
  misc_feature: Pfam Name: F420_oxidored Pfam Description: NADP oxidoreductase coenzyme F420-dependent
aaagctggagctccccgcggtggcggccgctctagaactagtggatcccccgggctgcaggaattcgcacgagaccattacctagaacatcctaatcgaaagttcgccacccgtccaaaagcccccaaccaaagcccgctccggcagcccccaccccaccatcttgtcaatggcggcgcctcatgtccatcctgtgccaaccgcggcggcggccgcggcggctgtgaactggaactcattccgtctgggcttcgacggagcgcgcaactctgaaccagagcatcgcccgcggcgtggaggcttcggacgtcctcacagcctccgccaaccgcaccgcgcccaaccgacattacaagcgcggcgaggacttagagtccttcggagcatgattgctccagacaatgcccatgttatacacaacagcgatgtgatcgtcatcactgtgaacgctcaaatcgtgaagcaagttctacttcagctgacgtcacggctagtggaaaaaaagctctcatgtccattgctgccggccataatatgcagattttctcgactgggctggtcaccgacgttttttttagtaatgcccaggccccttccccctgtggaaaaactcgaaaaaccat

SEQ ID NO: 37784 - DNA, 635 bp, Zea mays
  misc_feature: Ceres CLONE 1424412-F
  misc_feature (408)..(408): n is a, c, t, g, unknown, or other
  misc_feature (450)..(450): n is a, c, t, g, unknown, or other
  misc_feature (453)..(453): n is a, c, t, g, unknown, or other
  misc_feature (496)..(496): n is a, c, t, g, unknown, or other
  misc_feature (549)..(549): n is a, c, t, g, unknown, or other
aagctggagctccccgcggtggcggccgctctagaactagtggatcccccgggctgcaggaattcgcacgagaccattacctagaacatcctaatcgaaaaatacctttctcggccttttggctaagatcaagtgtaatatctgtttttatcagtttaatatctgatatgtgggctatgtgcctacttcgatattaaatttattttttgtgggagagggtccattgccggtggcttgcccttgggggctctcatgcgtcgtccagctattgcattctgctggccggacctggcgcaccccaaccaaaacaaagtaagcttgttcgtactctcttgggtttgcctatgtgacttttggaatatggtaagcaaaaccttttttgcgtttcgtcttatggctgaagctgcnagtcttccggaaaaacccggcctggaaccgttgaagacgacnccnacaacgatccggttttctatcgttccgtttccgttcgtttccntcccacccaacagaagagacagccccgaaagttgccagtccatcccaacccancagaggactactttattccagcagtgtctatcacaaatttcttgctgccaccagttcgtgggagtgcatcaggactagatcatgtt

SEQ ID NO: 37785 - DNA, 648 bp, Zea mays
  misc_feature: Ceres CLONE 1424423-F
  misc_feature: Encodes the peptide sequence at SEQ ID NO. 37786
aaagctggagctccccgcggtggcggccgctctagaactagtggatcccccgggctgcaggaattcgcacgagaccattacctagaacatcctaatcgaaaaaaaaaccctaatcgcgacctgcgttcgtcaaaaccctacctggccatggacggcggaggaggaggcggtggaggaggaggtggagttggggcaggtgtcatggtgggtggcggagtcgtgccgggcggcgggggcggcgacatggaactcgtcagcaagacgctgcagttcgagcacaagctgttctactttgatctgaaggagaacccgcgggggaggtacctcaagatctccgagaagacatcggccacgcgctccaccatcatcgtccccatcgacggcgtcgcctggttcctcgacctcttcgactactacatccgcaccgacgagcgcgacgtcttcagcaaggagctgcgactccagaccaaggtgttctatttcgatatcggggagaacaagaggggccgattcctcaagattttcgttgattcaagacatctaggtcctaaatgagtatgctgactaagtattccattgctatgtggatcatggacccatctgttcagtggcagtcttctttcaccaaggttcgatttcaacaatagg

SEQ ID NO: 37786 - protein, 135 aa, Zea mays
  misc_feature: Ceres CLONE 1424423-F
MDGGGGGGGGGGGVGAGVMVGGGVVPGGGGGDMELVSKTLQFEHKLFYFDLKENPRGRYLKISEKTSATRSTIIVPIDGVAWFLDLFDYYIRTDERDVFSKELRLQTKVFYFDIGENKRGRFLKIFVDSRHLGPK

SEQ ID NO: 37787 - DNA, 617 bp, Zea mays
  misc_feature: Ceres CLONE 1424436-F
  misc_feature: Encodes the peptide sequence at SEQ ID NO. 37788
aaagctggagctccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaccgtagtggaggtagctatgcctct

SEQ ID NO: 37788 - protein, 126 aa, Zea mays; identical to SEQ ID NO: 15591
  misc_feature: Ceres CLONE 1424436-F
  misc_feature (36)..(122): Pfam Name: Tryp_alpha_amyl Pfam Description: Protease inhibitor/seed storage/LTP family

SEQ ID NO: 37789 - DNA, 702 bp, Zea mays
  misc_feature: Ceres CLONE 1424440-F
  misc_feature: Translation starting site: 188
  misc_feature (515)..(515): n is a, c, t, g, unknown, or other
  misc_feature (702)..(702): n is a, c, t, g, unknown, or other
agagctggagctccccgcggtggcggccgctctagaactagtggatcccccgggctgcaggaattcgcacgagaccattacctagaacatcctaatcgaaaattcccttctgtcgctgctcccacctctagcccgacaggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacgcccaaatacagatgttgttgtgcgatttaccaacaaggacatcacagcacaaatcatctctgctagtatagcaggtgatatggttcttgcttctgcttactcgcatgagtcgcccacaatatggtcctagaattgggtctgaccaattatgcagctgcctactgcattgggctttttgttggccccnccttgggctcagaaacccgggtttaatataaggaaatttgaggggaaagttgagggccccgggggaggaactttcttgttggagccagtttaaaggaaggaagggccttttccgggccctctttggaagggtggccctttttaagaaaccccccgtgggaaacaccgttttttttggggccccccan

SEQ ID NO: 37790 - DNA, 648 bp, Zea mays
  misc_feature: Ceres CLONE 1424441-F
  misc_feature: Encodes the peptide sequence at SEQ ID NO. 37791
tggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgc

SEQ ID NO: 37791 - protein, 108 aa, Zea mays; identical to SEQ ID NO: 16131
  misc_feature: Ceres CLONE 1424441-F

SEQ ID NO: 37792 - DNA, 645 bp, Zea mays
  misc_feature: Ceres CLONE 1424449-F
  misc_feature: Encodes the peptide sequence at SEQ ID NO. 37793
ggagctccccgcggtggcggccgctctagaactagtggatcccccgggctgcaggaattcgcacgagaccattacctagaacatcctaatcgaaaaaactactccgtcactttgtatgcaaagctcctcctcgatccatcaatcactgcaccggccggcggcaccgcgctcgcaggggctacccaacgagacggcagcaatggcggaccgtgaccgcagcagcatctacggcggcgcccacgccacctacgggcagcagcaccagcagggacgaggcgggcacccgaagggtgagcacgtgaagggcatgctccacaacaaagggcctaatgcgtcccaagcgctgacggaggccacgctgttcccgctgcgcaggctgctgctggagctgtccgggctggcgctgactgcctccgaggtggtgctggccgtgaccacgccgatgttcctgatcttcagccccgtgctggtcgccgacgagctgctcatcaggacggccgtcatgcggattctcacgtcaggcgcactggggctcgagggcctgtcctcgctcacgtgcctcgccaacacggcgcagcaggtgttccagcgcaccccgcactacgtggaggaggcgcaccgcacgatggcggacgccgcaccgcc

SEQ ID NO: 37793 - protein, 148 aa, Zea mays
  misc_feature: Ceres CLONE 1424449-F
  misc_feature (44)..(147): Pfam Name: Oleosin Pfam Description: Oleosin
MADRDRSSIYGGAHATYGQQHQQGRGGHPKGEHVKGMLHNKGPNASQALTEATLFPLRRLLLELSGLALTASEVVLAVTTPMFLIFSPVLVADELLIRTAVMRILTSGALGLEGLSSLTCLANTAQQVFQRTPHYVEEAHRTMADAAP

SEQ ID NO: 37794 - DNA, 647 bp, Zea mays
  misc_feature: Ceres CLONE 1424451-F
  misc_feature: Encodes the peptide sequence at SEQ ID NO. 37795
  misc_feature (502)..(502): n is a, c, t, g, unknown, or other
  misc_feature (599)..(599): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaatccacctgtcctcgcgtctcccttcccagatccatcgactcgctcgggccgcccctcccgtcgtccccgttcgaaggtgcggcagccggcaggcgagcgatttgattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgcttcaggacaatcactagcagctactaccgcggagctcatggaatcattattgtatatgacgtgacagaccaagaaagcttncataatgtgaaagcatgggtgaacgagatagacccgttatgcagtgataatggtaaacagctccttggtggggacaagagtgactttactgccaacnnaagtgtggcactgagacagcaaaggcgtttgctgatgagagggcatc

SEQ ID NO: 37795 - protein, 144 aa, Zea mays
  misc_feature: Ceres CLONE 1424451-F
  misc_feature (10)..(142): Pfam Name: Ras Pfam Description: Ras family
  misc_feature (10)..(124): Pfam Name: Miro Pfam Description: Miro-like protein
  misc_feature: SWISSPROT Homolog: EC 2.7.11.1 Non-specific serine/threonine protein kinase
  misc_feature (96)..(96): Xaa is any aa, unknown, or other
  misc_feature (129)..(129): Xaa is any aa, unknown, or other
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESXHNVKAWVNEIDPLCSDNGKQLLGGDKSDFTANXSVALRQQRRLLMRGH

SEQ ID NO: 37796 - DNA, 648 bp, Zea mays
  misc_feature: Ceres CLONE 1424453-F
  misc_feature: Encodes the peptide sequence at SEQ ID NO. 37797
tggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgccacctgcttaccacttggatcctggctccggagcgggcagcagaagctggattgtgaacttagagggaggtgcgtggtgcaacagcgccaagacatgccggctcaccaggagctccggccgtggctcgtcggaccacatggacaaagagatccccttcaccggcatcatgagcagcagccgtaccgtgaatcctggtctcgcccgattctaatttctacatctggaaccgggt

SEQ ID NO: 37797 - protein, 146 aa, Zea mays
  misc_feature: Ceres CLONE 1424453-F
  misc_feature (41)..(147): Pfam Name: PAE Pfam Description: Pectinacetylesterase
MADRPSLPALIIAIAVLAGSYCRVASSASPAVEDELRGGGGAGGPTTMRRRAASVMVPITILKSAVSDGAVCMDGTPPAYHLDPGSGAGSRSWIVNLEGGAWCNSAKTCRLTRSSGRGSSDHMDKEIPFTGIMSSSRTVNPGLARF

SEQ ID NO: 37798 - DNA, 690 bp, Zea mays
  misc_feature: Ceres CLONE 1424457-F
  misc_feature (323)..(323): n is a, c, t, g, unknown, or other
  misc_feature (324)..(324): n is a, c, t, g, unknown, or other
  misc_feature (338)..(338): n is a, c, t, g, unknown, or other
  misc_feature (353)..(353): n is a, c, t, g, unknown, or other
  misc_feature (356)..(356): n is a, c, t, g, unknown, or other
  misc_feature (387)..(387): n is a, c, t, g, unknown, or other
  misc_feature (400)..(400): n is a, c, t, g, unknown, or other
  misc_feature (406)..(406): n is a, c, t, g, unknown, or other
  misc_feature (426)..(426): n is a, c, t, g, unknown, or other
  misc_feature (430)..(430): n is a, c, t, g, unknown, or other
  misc_feature (434)..(434): n is a, c, t, g, unknown, or other
  misc_feature (435)..(435): n is a, c, t, g, unknown, or other
  misc_feature (438)..(438): n is a, c, t, g, unknown, or other
  misc_feature (439)..(439): n is a, c, t, g, unknown, or other
  misc_feature (449)..(449): n is a, c, t, g, unknown, or other
  misc_feature (451)..(451): n is a, c, t, g, unknown, or other
  misc_feature (457)..(457): n is a, c, t, g, unknown, or other
  misc_feature (463)..(463): n is a, c, t, g, unknown, or other
  misc_feature (465)..(465): n is a, c, t, g, unknown, or other
  misc_feature (466)..(466): n is a, c, t, g, unknown, or other
  misc_feature (468)..(468): n is a, c, t, g, unknown, or other
  misc_feature (471)..(471): n is a, c, t, g, unknown, or other
  misc_feature (480)..(480): n is a, c, t, g, unknown, or other
  misc_feature (491)..(491): n is a, c, t, g, unknown, or other
  misc_feature (501)..(501): n is a, c, t, g, unknown, or other
  misc_feature (503)..(503): n is a, c, t, g, unknown, or other
  misc_feature (504)..(504): n is a, c, t, g, unknown, or other
  misc_feature (506)..(506): n is a, c, t, g, unknown, or other
  misc_feature (509)..(509): n is a, c, t, g, unknown, or other
  misc_feature (538)..(538): n is a, c, t, g, unknown, or other
  misc_feature (541)..(541): n is a, c, t, g, unknown, or other
  misc_feature (542)..(542): n is a, c, t, g, unknown, or other
  misc_feature (558)..(558): n is a, c, t, g, unknown, or other
  misc_feature (564)..(564): n is a, c, t, g, unknown, or other
  misc_feature (595)..(595): n is a, c, t, g, unknown, or other
  misc_feature (598)..(598): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (604)..(604): n is a, c, t, g, unknown, or other
gctctagaactagtggatcccccgggctgcaggaattcgcacgagaccattacctagaacatcctaatcgaaaagaacatgatcaaagccctgcaaatccttctccccctgcacgcacctgcacacctgctctctcgcgcgcatgctcccgtgcccctcactgtttagtggcgacgactgggcgacagtcgcctccaccgccggctaggggccgcgcccctggtctccatcttcgggcgcttcgcccgccacatatgagcagctgccgattcgattttgaggcccttatttgataacccgggaccagtggcctgtaacctgannattttagcttgttnggatgggtatatgantgnatggttcgggctggtcagcccccccccttgnagtgggttaaaanatgtcngggattggaagggtacgccngacngggnnccnngaagtgcccnanctttgntcgacngnncnttncgggggttntgcagtcccgnttggggaaantnntncgngaggaaagaatcttttgaaaagaaagagnggnncctccaactttttcanggaggntctccgcaaccccgccaaccaccacccccanagntnnncnctggaggggctcctctaaggggagcctttttctatcccccgcggctccctccggaccgccactaattgcctcatccataaaacaat

SEQ ID NO: 37799 - DNA, 647 bp, Zea mays
  misc_feature: Ceres CLONE 1424461-F
  misc_feature: Encodes the peptide sequence at SEQ ID NO. 37800
aagctggagctccccgcggtggcggccgctctacaactagtggatcccccgggctgcatgaattcgcacgagaccattacctagaacatcctaatcgaaaaacaaataagagctaaaatggaaaccatagtccacaagtcgatgatcgccggactacagagcgttatgccggtggaaatgacgcaccaccgtgaagtacgttccatatccgtcggagatcccgtcggagcaggaatattcaggagaacactaaacatagttacgtactacaagcaatccggtgatagtggtgagagagggtggttagtcgccggttggataaaggagtcgttagggagagccttgaccgagcagcctttgctttgtggtacactgcgccggatgaggacggtgaagggagaggaagatggtctggaggtggagaccaacgatagtggcgctaggctggtggaggctaggttcccggcgagtttgccggagtcttttgaagtggtgcagagagactaaaacatagcttaagcacagactgtcttctggagagacattgaagaagttgatcctcagatctctccattgttctatgttcaggtgactaatttcgagagtgctggatactcaattgggataagctgccgcatcctagtagc

SEQ ID NO: 37800 - protein, 129 aa, Zea mays
  misc_feature: Ceres CLONE 1424461-F
METIVHKSMIAGLQSVMPVEMTHHREVRSISVGDPVGAGIFRRTLNIVTYYKQSGDSGERGWLVAGWIKESLGRALTEQPLLCGTLRRMRTVKGEEDGLEVETNDSGARLVEARFPASLPESFEVVQRD

SEQ ID NO: 37801 - DNA, 607 bp, Zea mays
  misc_feature: Ceres CLONE 1424466-F
  misc_feature: Encodes the peptide sequence at SEQ ID NO. 37802
  misc_feature (430)..(430): n is a, c, t, g, unknown, or other
  misc_feature (503)..(503): n is a, c, t, g, unknown, or other
  misc_feature (519)..(519): n is a, c, t, g, unknown, or other
tggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatanagagtgttggagagggtgtgactgacgtagctccgggcgaccatgtccttccctgtgtcactggggagtgcanggagtgtgcccactgnccagtcgcagaagagcacatgtgtgatctgctcaggatcaccaccgacgccgtgtgatgattgcgatggccagtcccggttttcatcc

SEQ ID NO: 37802 - protein, 123 aa, Zea mays
  misc_feature: Ceres CLONE 1424466-F
  misc_feature (34)..(115): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (76)..(76): Xaa is any aa, unknown, or other
  misc_feature (100)..(100): Xaa is any aa, unknown, or other
  misc_feature (105)..(105): Xaa is any aa, unknown, or other
MATAGKVIKCKAAVAWEAGKPLSIEEVEVAPPQAMEVRVKILFTSLCHTDVYFWEAKGQTPVFPRIFGHEAGGIIXSVGEGVTDVAPGDHVLPCVTGECXECAHXPVAEEHMCDLLRITTDAV

SEQ ID NO: 37803 - DNA, 671 bp, Zea mays
  misc_feature: Ceres CLONE 1424487-F
  misc_feature: Encodes the peptide sequence at SEQ ID NO. 37804
  misc_feature (389)..(389): n is a, c, t, g, unknown, or other
  misc_feature (390)..(390): n is a, c, t, g, unknown, or other
  misc_feature (402)..(402): n is a, c, t, g, unknown, or other
  misc_feature (527)..(527): n is a, c, t, g, unknown, or other
aaagctggagctccccgcggtggcggccgctctagaactagtggatcccccgggctgcaggaattcgcacgagaccattacctagaacatcctaatcgaaaaaatgccatgcgcgcgctactgcatctgcggctcatcaatccgtgcagtcccagagcaccccgtcttcccgctactcccgcaagggcgctcgtcgcttccttctccgggacgtggcaggcaccttctggtagagcgagagcgagagcagcgccgccggcagttcgcgctatggcgtcccagcaggtgttccgggctcagcagcagcagcagcagcagttcccggctcagcagcaggagtcccagccggggaaggagcacgcgatggaccccccggcccgagccatcgnntcagactacaangccgccaaacagctcaaaggacaggtgccgctcgtgaccgggcgcgactcggcatcgggcgccccttgtgcctgttctccccaaaggaggccccaacgtgggcttttccttttcggaaggggccngaaaaaaaagaccccaaaaaaaactttggggccttgccaaattcggttccaaaaaggggcccccgaaccaaatggcccttcccccaacccccggaaaaaaaccaatccccgagaggtggaaaaacgggggccctcccccccacg

SEQ ID NO: 37804 - protein, 133 aa, Zea mays
  misc_feature: Ceres CLONE 1424487-F
  misc_feature (40)..(40): Xaa is any aa, unknown, or other
  misc_feature (44)..(44): Xaa is any aa, unknown, or other
  misc_feature (86)..(86): Xaa is any aa, unknown, or other
MASQQVFRAQQQQQQQFPAQQQESQPGKEHAMDPPARAIXSDYXAAKQLKGQVPLVTGRDSASGAPCACSPQRRPQRGLFLFGRGXKKKTPKKTLGPCQIRFQKGAPEPNGPSPNPRKKTNPREVEKRGPSPP

SEQ ID NO: 37805 - DNA, 605 bp, Zea mays
  misc_feature: Ceres CLONE 1424489-F
  misc_feature (238)..(238): n is a, c, t, g, unknown, or other
  misc_feature (245)..(245): n is a, c, t, g, unknown, or other
  misc_feature (299)..(299): n is a, c, t, g, unknown, or other
  misc_feature (300)..(300): n is a, c, t, g, unknown, or other
  misc_feature (310)..(310): n is a, c, t, g, unknown, or other
  misc_feature (324)..(324): n is a, c, t, g, unknown, or other
  misc_feature (342)..(342): n is a, c, t, g, unknown, or other
  misc_feature (357)..(357): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacnagcggcnggctgcggctggcagccaccgccgccggttcatctaccggcggcggtgcatctnngcacctcggntcacctggcacctncgggtgcatcttccaccncgggtccacttgccngcccccggtccactgccacccgccggcctttggcccccccccggttaatttgcgccccccccatggcctttccttattaaacggcccgggttttagctcttttcccggcacacccttggctgggggcaaaacccattttaaaacccggggcatttgaggggaaactgggcggtttgggaaccccccactcttgggccaagggggcaaaattttttaaaggacattggggccccccacgggggcccccc

SEQ ID NO: 37806 - DNA, 639 bp, Zea mays
  misc_feature: Ceres CLONE 1424496-F
  misc_feature: Encodes the peptide sequence at SEQ ID NO. 37807
  misc_feature (554)..(554): n is a, c, t, g, unknown, or other
aagctggagctccccgcggtggcggccgctctagaactagtggatcccccgggctgcaggaattcgcacgagaccattacctagaacatcctaatcgaaaaaggtcttcctctcgcgagttgcggtctcgcgcccccctccgccgaccgccgcctcctcacaaccgcggaagctgcttccctctccattggacgcggccagcttccatctctcggtcacctccctctacatcccacggccgctaccaccttccctctacctcacacggccgccggcctctccaaggtctgcacacggaaaaaccttgccacgagtcgccgacactccatcccggaagagctaacgaggtgactccccaccgcgcccatgggtgacagccagtactccttctccctcaccaccttcagtccgtcggggaagctcgtgcagattgagcacgcgctcacggctgtcggatccgggcagacctcgctcgggatcaaagctgccaatggtgtagtcattgccactgagaagaagctgccttctattttagtggatgaaacatctgtgcnaaagattcaggcactaacacctaatattggagttgcctaaaggggggaaggggccaaaatttccgggtcccgggggagaaaaaaa

SEQ ID NO: 37807 - protein, 75 aa, Zea mays
  misc_feature: Ceres CLONE 1424496-F
  misc_feature: SWISSPROT Homolog: EC 3.4.25.1 Proteasome endopeptidase complex
  misc_feature (63)..(63): Xaa is any aa, unknown, or other
MGDSQYSFSLTTFSPSGKLVQIEHALTAVGSGQTSLGIKAANGVVIATEKKLPSILVDETSVXKIQALTPNIGVA

SEQ ID NO: 37808 - DNA, 655 bp, Zea mays
  misc_feature: Ceres CLONE 1424501-F
  misc_feature: Encodes the peptide sequence at SEQ ID NO. 37809
aaagctggagctccccgcggtggcggccgctctagaactagtggatcccccgggctgcaggaattcgcacgagaccattacctagaacatcctaatcgaaaaagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccggcgcggccgtggaggcggcggcggcggcgggtacggtgggtgccgtggaggcggcggctacggcggtggcgggcgccatgatggcggcggcggctacggcggtggcggcggctacagtggtggcggcagcagctacggtggtggtggcgggcgctacggcggtgggcaccgtgggcgcggctacggcaactccgacgggaactg

SEQ ID NO: 37809 - protein, 154 aa, Zea mays
  misc_feature: Ceres CLONE 1424501-F
  misc_feature (10)..(81): Pfam Name: RRM_1 Pfam Description: RNA recognition motif. (a.k.a. RRM, RBD, or RNP domain)
  misc_feature (48)..(147): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRRGRGGGGGGGYGGCRGGGGYGGGGRHDGGGGYGGGGGYSGGGSSYGGGGGRYGGGHRGRGYGNSDGN

SEQ ID NO: 37810 - DNA, 680 bp, Zea mays
  misc_feature: Ceres CLONE 1424502-F
  misc_feature: Pfam Name: Terpene_synth_C Pfam Description: Terpene synthase family, metal binding domain
  misc_feature: SWISSPROT Homolog: EC 4.2.3.13 (+)-delta-cadinene synthase
  misc_feature: SWISSPROT Homolog: EC 4.2.3.17 Taxadiene synthase
ctggagctccccgcggtggcggccgctctagaactagtggatcccccgggctgcaggaattcgcacgagaccattacctagaacatcctaatcgaaaaacctttgcttcaaaagcgggctaaggaccctcttgctttctcctttgacctctcctccttctgccggcacaagaaaaaggaaagcgccgccaccaaaaatagccattgacagcaagtccggatagagtagctgggtggatatatcgccacgtctcaagtctcgggggcgaattcacgagctttggtcgcgttgaagggtctcgcgcgagatgggaccatactaaagttcgccaagctggattacaacatctcgcaagctatctactgtgatgaactgaaagaacttactgtatgggggaaggatttccaatcacatatagatatgcgcttcacgcgggacagattgagtggagcttcatttctggatgctcggagtgatacatgagccatattactcgtattcgcggatcatgatgaccaagttctacatattcgcaaactttttccatgacctttacgacaactatggcaccacacaggatagcgatgccttcaccgcagccatggaaaggtgggatgaacagatcgctcatcaactttcagcaggcttgaaggtactcttggtcagcatattgaatgcta

SEQ ID NO: 37811 - DNA, 641 bp, Zea mays
  misc_feature: Ceres CLONE 1424526-F
  misc_feature: Encodes the peptide sequence at SEQ ID NO. 37812
aaagctggagctccccgcggtggcggccgctctagaactagtggatcccccgggctgcaggaattcgcacgagaccattacctagaacatcctaatcgaaaaatcaccaccactgggtcttcagaccattagctttatcttctccccagcgcaaaaaaccccgatcgacacgtggagggtgttgctcgttgccctcgctctcctggctctcgctgctagcgccacctccactcttactaccggtggctgctgctgccacccaccgccgacgggtcatctaccgccgccggtgcatctgccacctccggttcacctgccacctcaggtgcatctcccaccgccggtcacacctgccgcacgccggtccacctgccaccgccggatccatgtgccgccgccggttcatcatgccaccaccaccatgcctcgtaccctactcaaccgacgcggcctcagcctcagtccccagccacacccatgcccgtgtcaactgccgcatccaagcccgtgccacctgcctggaacctgcagcgttggctgcaccccgatcctgcgccagtgctcctagttcctaaggaatcagtgcaccccgactgcgactccctactgctcgcctcagtgccactctttgcagcagcact

SEQ ID NO: 37812 - protein, 48 aa, Zea mays
  misc_feature: Ceres CLONE 1424526-F
MPRTLLNRRGLSLSPQPHPCPCQLPHPSPCHLPGTCSVGCTPILRQCS

SEQ ID NO: 37813 - DNA, 742 bp, Zea mays
  misc_feature: Ceres CLONE 1424532-F
  misc_feature (188)..(188): n is a, c, t, g, unknown, or other
  misc_feature (195)..(195): n is a, c, t, g, unknown, or other
  misc_feature (196)..(196): n is a, c, t, g, unknown, or other
  misc_feature (447)..(447): n is a, c, t, g, unknown, or other
  misc_feature (536)..(536): n is a, c, t, g, unknown, or other
  misc_feature (544)..(544): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (639)..(639): n is a, c, t, g, unknown, or other
ggtgctggagctcaccgcggtggcggccgctctagaactagtggatcccccgggctgcaggaattcccacgagaccattacctagaacatcctaatcgaaaactgcacacattccgcgcacaccccggcagccgcaaacgccttcgccgtcgcgtcccggtcctccgcccggcggaggggacccctangacctgnnaagagagggcggcatggctccccccagtggcccacaacccttgtattggcccccgtcccaaaccccctcatgtcccaaaaggaatccatttttttttccccccccggggaggggggtctccccctccgcgcttttttttttgtccgcttcacgtaacacggggggaggaggttttttttttcccccccccggtggggggaaaagaaagggggtaaaccctccctccccctcttcccctcctcccccgatcnctccctaccacccaaaagagcccccccccccgccccctagcgaggggcgggggattcgtcccccttatgtgacgtcgcctccgccgtcngataacangacacactgtgacgcaggtaaagtgtgatgcttttgtatctgccgcccgccgcccccccccggcctcgcggnnnnnnattttatnnnttgtcccntcccccctcttcgcgaccgacccccgccccctcaggccggtgtgcgggcgccgccgcccggccccgcggccgccctctagcgcggacggcacgccgtttgtgg

SEQ ID NO: 37814 - DNA, 658 bp, Zea mays
  misc_feature: Ceres CLONE 1424536-F
  misc_feature: Encodes the peptide sequence at SEQ ID NO. 37815
aaagctggagctccccgcggtggcggccgctctagaactagtggatcccccgggctgcaggaattcgcacgagaccattacctagaacatcctaatcgaaaaactgccctggtcccccattcaattcttccaactccgccgcttcgcctcgttccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgcccccgcctccgccgccgccgccgcctcctcccacgctgccacctacgagaacccgtggtcccacggtcgcggaggttaccaagcctgcgggtgaccacggagtacgatagctaagagggcgtgtttgtgaacaaggtgtcgtgcaagcttgcgggggacctcgccaaactgcggctctccttccagagcgacccgcaggggcagtgcccatggggcgggggaggaaggattactcgacttcagtagctacttcaccgcagccagttggtgtgactcatcaccaggacgttgctctgtgcttctaggacaacgaggcaccgcaaggtgctgtctcctcgggaaactgttccgctgtccaga

SEQ ID NO: 37815 - protein, 79 aa, Zea mays
  misc_feature: Ceres CLONE 1424536-F
MASAAATTTSAPAQNLNPLSINIKLPPWLSGLRCPFTFVCPPPPPPPPPPPPPPTLPPTRTRGPTVAEVTKPAGDHGVR

SEQ ID NO: 37816 - DNA, 585 bp, Zea mays
  misc_feature: Ceres CLONE 1424541-F
  misc_feature: Encodes the peptide sequence at SEQ ID NO. 37817
aagctggagctccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaagactagagttgagatatcattggctgactcttccgagaacatgctggctgacacttacgtgtggagtgatgcagagcatctcattctttatggagatggggacttttgagggatatgacttgtttccggcagcccgggggggttaatgccatgggataa

SEQ ID NO: 37817 - protein, 131 aa, Zea mays
  misc_feature: Ceres CLONE 1424541-F
  misc_feature (19)..(118): Pfam Name: AIG2 Pfam Description: AIG2-like family
MAMKPAAAAPPTPAAAHSVFVYGSLMADEVVRTILKRVPPAAPALLPNYHRFNIKGRIYPAILPVESKRVAGRVIMGVTDEELQLLDAFEDVEYTKTRVEISLADSSENMLADTYVWSDAEHLILYGDGDF

SEQ ID NO: 37818 - DNA, 639 bp, Zea mays
  misc_feature: Ceres CLONE 1424546-F
  misc_feature: Translation starting site: 203
  misc_feature (411)..(411): n is a, c, t, g, unknown, or other
  misc_feature (523)..(523): n is a, c, t, g, unknown, or other
ctggagctccaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtccaggcgctgacggtggcgacgctgttcccgctgggcgggctgctgctggtgctgtcggggctggcgctgacngcctccgtggtggggctggccgtggccacgccggtgttcctgatctttcagcccgtgctggtccccgccgcgctgctcatcgggaacgccgtcatgggggtccctcacgtcnggcgcgctggggctcgggggcctgtcctcgctcacgtgcctcgccaaacggcgcggcagggcgtccagcgcacccggactacgttgaggaggcccacccaggatggcgaagccccc

SEQ ID NO: 37819 - DNA, 623 bp, Zea mays
  misc_feature: Ceres CLONE 1424551-F
  misc_feature: Encodes the peptide sequence at SEQ ID NO. 37820
  misc_feature (461)..(461): n is a, c, t, g, unknown, or other
  misc_feature (469)..(469): n is a, c, t, g, unknown, or other
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgatgaccttgaacccactgtcatcgatgaggtgaggactggcnactaccgncagctcttccaccctgagcagctcatcagtggaaggaggatgcagccaaccactttgcccgtggtcactacaccattgccaggaaattggtgacctatgccttgatcgcatcaagaagcttggcaacactgcactggtctcaagggctcctcgn

SEQ ID NO: 37820 - protein, 114 aa, Zea mays
  misc_feature: Ceres CLONE 1424551-F
  misc_feature (82)..(82): Xaa is any aa, unknown, or other
MRECISIHIGQAGIQVGNACWELYCLEHGIQADGQMPGDKTIGGGDDAFNTFFSETGAGKHVPRAVFDDLEPTVIDEVRTGXYRQLFHPEQLISGRRMQPTTLPVVTTPLPGNW

SEQ ID NO: 37821 - DNA, 649 bp, Zea mays
  misc_feature: Ceres CLONE 1424555-F
aagctggagctccccgcggtggcggccgctctagaactagtggatcccccgggctgcaggaattcgcacgagaccattacctagaacatcctaatcgaaaacacaccacacgccagccagccatcgtcacgctggggagctctgcactctgcttagctccgagcttcagtgccttcgttgtttgggccacgcagtccacacacacacaccagtacgtccagctgcactgcaccaatggccgccgtcgaggtcccggtcccgactgccgctcccgtcgaggaggttgcacagctggccgccgcctccgccgtctagatcccaaacgacgagaccgctgctccagcggtggagacccaagtcgtcgtcgctaaagatccggtgccggccgaggccgagactgattccaaggaggtcgaggtctaggctgacgccgaggccgatgccgtatctgaagctgagccgaccgaggcagagcccgaggccgccttgccggcagcatatacggatgccaagaagcacaagcggaagccaccttgccggcagcatagacggaggctgctgctgccccggtctaagctgctgatccggacatatccgccgaagaccaaacaggtggcggctgtggaggctaacgaggaggaggatgaac

SEQ ID NO: 37822 - DNA, 645 bp, Zea mays
  misc_feature: Ceres CLONE 1424565-F
  misc_feature: Encodes the peptide sequence at SEQ ID NO. 37823
aaagctggagctccccgcggtggcggccgctctagaactagtggatcccccgggctgcaggaattcgcacgagaccattacctagaacatcctaatcgaaaaagacaaaacagcgtccccctccctctactaaaaaaaaaagggaggcatgagctccgcctcctcctcgtctctcgccgatctccccaaaccctagccccgacctgaccgccggcgggcccgccggccggagaaggagtcgctcccacccacccaacttctgcagcggaaggggagcgggcggcggactacatgccgtcgcacggggatctggaccggcagatcgcgcagctgcgcgactgcaagtacctgcccgaggcggaggtcaaggcgctctgcgagcaggccaaggccatccttatggaggagtggaacgtgcagcccgtgcgctgtcctgtcaccgtctgtggcgacatccacggccagttctatgacctcatcgagctcttccgcatcggaggcgacgctcccgacaccaactacctcttcatgggcgactacttcgatcgtggctactattcagtcgaaacagtttctctgttagtggctttgaaagtccgttactcagatagaattacgatacttaaaggacatcatgagagcaga

SEQ ID NO: 37823 - protein, 118 aa, Zea mays
  misc_feature: Ceres CLONE 1424565-F
  misc_feature: SWISSPROT Homolog: EC 3.1.3.16 Phosphoprotein phosphatase
MPSHGDLDRQIAQLRDCKYLPEAEVKALCEQAKAILMEEWNVQPVRCPVTVCGDIHGQFYDLIELFRIGGDAPDTNYLFMGDYFDRGYYSVETVSLLVALKVRYSDRITILKGHHESR

SEQ ID NO: 37824 - DNA, 649 bp, Zea mays
  misc_feature: Ceres CLONE 1424570-F
  misc_feature: Encodes the peptide sequence at SEQ ID NO. 37825
  misc_feature (611)..(611): n is a, c, t, g, unknown, or other
aaagctggagctccccgcggtggcggccgctctagaactagtggatcccccgggctgcaggaattcgcacgagaccattacctagaacatcctaatcgaaaaatctatctccctgtttaatcaatccttcaagcgcttgctgcctcctcctcgtcgtccggtcgtgagaagggatggcgggccgtggcaaggctatcggcgctggcgccgcgaagaaggcaacgtccaggagctccaatgccggactccagttccccgtcggccggattgctaggttcctcaaggcgggcaagtacgctgaacgcgtcagcgcctgcgcccccgtgtacctcgccgccgtcctcgagtacctcgcggctgacgttctcgaacttgccgggaacgccgcgagggacaacaataagaccacgattgtgccgcgccacatccagcttgctgtgcgcaacgacgaggagctgacctaactgttgggtggtgccagcatcgcgagccgaggtgttatgcctaacatccatcagcatctgcctcccgaaaaggctgccctcctctatgccagtgtcgacgacgacaacgactgagactgctccctgcagaaatgatccgaccaccgncttgttttgtttgaataggatgatgttgtcttcgatcg

SEQ ID NO: 37825 - protein, 96 aa, Zea mays
  misc_feature: Ceres CLONE 1424570-F
  misc_feature (19)..(92): Pfam Name: Histone Pfam Description: Core histone H2A/H2B/H3/H4
MAGRGKAIGAGAAKKATSRSSNAGLQFPVGRIARFLKAGKYAERVSACAPVYLAAVLEYLAADVLELAGNAARDNNKTTIVPRHIQLAVRNDEELT

SEQ ID NO: 37826 - DNA, 683 bp, Zea mays
  misc_feature: Ceres CLONE 1424577-F
  misc_feature: Encodes the peptide sequence at SEQ ID NO. 37827
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaatcatcaactgatcaaacagagacaaacctatactgctacatgcataatggttggtacatggtaaaactatagcaagctaaggtcgatcgctcgtctatagctagaccactaccacctccatggtttcttgactgatagatagacggacgagaatgaagaagctagctagctactagatatatcatcagtagagtgttcagttgttgatgatggcctcctccttgcccctggtcaccactgggctgcgccatcctcctcctccgcagcagtcgccgagggtggtcctgcagagcgaggacccgaccgagtggtgcgcgtgggcgcaccaggggcaccgcctgtgggtggccatgccggactccttctgggtgtacacgtacaaggtggaccggtgcccgttccggggcaaccacgtgtggacgacgtgcccgtacgcgcactggggggagcgcgcgcgccgccgcgaccccagccgctacgcgtacgccgccgcgacgtgcccggactacgccgactccaagcgccggaaccgcctggccgggtccaccgcgccccccacctgcgcgcgcggcctccgct

SEQ ID NO: 37827 - protein, 124 aa, Zea mays
  misc_feature: Ceres CLONE 1424577-F
MMASSLPLVTTGLRHPPPPQQSPRVVLQSEDPTEWCAWAHQGHRLWVAMPDSFWVYTYKVDRCPFRGNHVWTTCPYAHWGERARRRDPSRYAYAAATCPDYADSKRRNRLAGSTAPPTCARGLR

SEQ ID NO: 37828 - DNA, 655 bp, Zea mays
  misc_feature: Ceres CLONE 1424593-F
  misc_feature: Translation starting site: 155
  misc_feature: SWISSPROT Homolog: EC 1.2.1.3 Aldehyde dehydrogenase (NAD(+))
  misc_feature (42)..(42): n is a, c, t, g, unknown, or other
  misc_feature (50)..(50): n is a, c, t, g, unknown, or other
  misc_feature (117)..(117): n is a, c, t, g, unknown, or other
  misc_feature (128)..(128): n is a, c, t, g, unknown, or other
  misc_feature (398)..(398): n is a, c, t, g, unknown, or other
ctccccgcggtggcggccgctctagaactagtggatcccccngggctgcnaggaattcgcacgagaccattacctagaacatcctaatcgaaaacatccgctccccgccttccgctntccctaccccnccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaagagggcatgcgcgcctgcttcgatgccgccaagacatggatggcgattcctgctcccaagcganggagagatcgtagccaaatcggtgatgcactgagagcaaagctccatcaccttggcaggcttgggtccacttgaaatggggaaaattctcctggaagggatcggtgaagttcagggaatcaccccactgtgggaatttgccgtggggggaaacccccaacttaagggttcctttaacccttcggaacccccaccccttgggggggggggggggggaacccccttgggattggggggggttaaaaccgctttattttc

SEQ ID NO: 37829 - DNA, 719 bp, Zea mays
  misc_feature: Ceres CLONE 1424594-F
  misc_feature: Encodes the peptide sequence at SEQ ID NO. 37830
  misc_feature (719)..(719): n is a, c, t, g, unknown, or other
aagctggagctccccgcggtggcggccgctctagaactagtggatcccccgggctgcaggaattcgcacgagaccattacctagaacatcctaatcgaaaaatcgatccagtgcaaacaagctcgctcgcaagcgcaacccacccacgtctaccacacgaagcatcgtagccagccacccatccagccagctaaacccacacatggccgggatcgtggtggtgttcgacttcgacaagacgatcatcgacgtggacagcgacaactgggtggtggacagcctcggcctcaccgacctgttcgagcgcctcctccccaccacgccctggaacacgctcatggacacgatgatgggggagctgcacgcgcggggcaggacgctggccgaggtgaccgaagcgctcagggcggcgcccatcgacccgcgcgtgcccgccgccgtcagggccgcgcacgcgctcggctgcgacctgcgcgtgctcagcgacgccaacgccttcttcatccacaccgtcctggacccacacgggctgctcgactgcttctccagatcaacaccacccccagcgcgtcgacgcccacggcgaactcgcatcgggccctgccacgacccgcgcgcggcgcgcacggctgcggcgtcggcacctgcccgccaaacatggtgaagggcctcgtgctgaaccgcatcttccgcaaggccgaggccgaagccgcatcctn

SEQ ID NO: 37830 - protein, 153 aa, Zea mays
  misc_feature: Ceres CLONE 1424594-F
  misc_feature (4)..(154): Pfam Name: Put_Phosphatase Pfam Description: Putative Phosphatase
  misc_feature: SWISSPROT Homolog: EC 3.1.3.74 Pyridoxal phosphatase
MAGIVVVFDFDKTIIDVDSDNWVVDSLGLTDLFERLLPTTPWNTLMDTMMGELHARGRTLAEVTEALRAAPIDPRVPAAVRAAHALGCDLRVLSDANAFFIHTVLDPHGLLDCFSRSTPPPARRRPRRTRIGPCHDPRAARTAAASAPARQTW

SEQ ID NO: 37831 - DNA, 645 bp, Zea mays
  misc_feature: Ceres CLONE 1424614-F
  misc_feature: Translation starting site: 220
  misc_feature: Pfam Name: ER_lumen_recept Pfam Description: ER lumen protein retaining receptor
aaagctggagctccccgcggtggcggccgctctagaactagtggatcccccgggctgcaggaattcgcacgagaccattacctagaacatcctaatcgaaaaaggagtcaggtcctcacgccgcgcacgggccacagacgacgagagcgcgcccatccggacccggacagagtcatcgcctgcgcctgcgcctccaccgatgggtaatcgggaggggagatgaagggttcgtcgcggaggcctgtcgccatgctgatggcctgggtgcagccccagccacccaaagtcaaggccttcctcggcgtcctcgctgagatggctgcactcctcttcatccgcttcatcgtcgcacgaccaatactacctcttcgtcgcctcatagggcgcggacgcgctctggatctccgtgctcatctacaagctcaccagagataagacctgctgctgattgtcgctcacgtctcacgagttgactgcgttatttctggccgctacgccggattgcacttttgttatgcactatgacatccctacaagtctggatacagctgcacttgcagctactcttcttgttacttacatgatgcggttcccactgaggtgcacgtatatgctgcaccaagacaactatgaccttgcactatg

SEQ ID NO: 37832 - DNA, 655 bp, Zea mays
  misc_feature: Ceres CLONE 1424615-F
  misc_feature: Encodes the peptide sequence at SEQ ID NO. 37833
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaagaaagcagagagagccggcaacatcgcagagagagagagagagagagagaggcaaactggagaggccgagggtgatggtttccaaggagcagaataagcgaggagctttgcatgagaagctcaagattctccgcagcgttactcactctcatgcgatcagtcatgctgtgtgtgctctgctatatatctacgtaccaataccattcagcttttcagaccattcctatgctgtcaagttatatgcaacacgcgtacgtgtgtgtgtgtcacgcatgcagggggataaagtgtcgataatagcggacgcgtcatcgtacatcaaggaactaaagcagaagatcgcgaagctaagccaagagatggcatcgtcgtctccgcagcacgccactagtgtctgccaacaacaaccgtcgtcgtcgtcggtgagtgtgggagtcctgctggacaagaagggccgtttcctcgtcagtgtgttcatggacgagagctgcggcccgccgccggccgggctactcgcttccgtcctcgaggccttcgacgagatcggactcn

SEQ ID NO: 37833 - protein, 159 aa, Zea mays
  misc_feature: Ceres CLONE 1424615-F
MVSKEQNKRGALHEKLKILRSVTHSHAISHAVCALLYIYVPIPFSFSDHSYAVKLYATRVRVCVSRMQGDKVSIIADASSYIKELKQKIAKLSQEMASSSPQHATSVCQQQPSSSSVSVGVLLDKKGRFLVSVFMDESCGPPPAGLLASVLEAFDEIGL

SEQ ID NO: 37834 - DNA, 640 bp, Zea mays
  misc_feature: Ceres CLONE 1424621-F
  misc_feature: Translation starting site: 148
  misc_feature: Pfam Name: Rotamase Pfam Description: PPIC-type PPIASE domain
aagctggagctccccgcggtggcggccgctctagaactagtggatcccccgggctgcaggaattcgcacgagaccattacctagaacatcctaatcgaaaaagggttttgggatgtgtactcccattgatcttgcgccgttgctcccatggccaaggactcctcctgtattgacgcctcggggacggccaagctggcggcccgttcctctggcggcgaccactctcgcagcaacgtacccccttcctcgggcaaggacgacgccggtccgcccgcttacagactccttccttgccacctaccttccatttacgcgcatattgcgtgacaagctagggaagatcgatgaaacttatcacaaattcccatatgcatggctcattgctgttgacaaaattcctcctgctgagtttgctaccgtaacacgatagtattctaaatgcccatctggtactaaaggtgtacatcttgtctggatcccgcatcacttatggatgcgtcctttccacatgttgctttcatcaccctgatgaaactgtgacgcaccgttctgtccacacatggtgatcactttatcctctgcgaatgaatcaagaactgatctcgagacgactgatggctatactgcatcaacctgttgt

SEQ ID NO: 37835 - DNA, 655 bp, Zea mays
  misc_feature: Ceres CLONE 1424646-F
  misc_feature: Translation starting site: 489
ggagctccccgcggtggcggccgctctagaactagtggatcccccgggctgcaggaattcgcacgagaccattacctagaacatcctaatcgaaaaacctagaacatcctaatcaaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcagcgttggcagcaccccgatcctgggccagtgcgtcgagtttctgaggcatcagtgcagcccgacggcgacgccctactgctcgcctcagtgccagtcgttgcggcagcagtgtt

SEQ ID NO: 37836 - DNA, 645 bp, Zea mays
  misc_feature: Ceres CLONE 1424652-F
  misc_feature: Encodes the peptide sequence at SEQ ID NO. 37837
agagctggagctccccgcggtggcggccgctctagaactagtggatcccccgggctgcaggaattcgcacgagaccattacctagaacatcctaatcgaaaaactactacctggcctcgcaggattcacaagggggccacacgctgatacctcctccttcacccgctccgtcgtcccccccagcgcggccacgacaccatgctgccaccggccgcgcgccttgaggcccgccgcctcctcggcctcgcctacgcatctgcgtcggaagccaccggccgccgggtagcttcctctccgatcgcttacgcaggctactccgccgccgcgtccaggggctccgtctagagcaccaggcccttctccacgggtcttaactaccaccttgagtcgccggagaacaagccggacatgaaatgggagttctcacaggcgaatataaagaaggtcaatgagattctgtctcactatccaagcaactacaagcaatctggtattattccgctgcttgatcttgcacagcagcagcatggtggatgggtaccagttgcaccaatggatgctattgctaaaaatagtcgaggttgcacccatcagggtctatgaagttgcaaccttctatatagtgcttagcaggactaacgttgg

SEQ ID NO: 37837 - protein, 64 aa, Zea mays
  misc_feature: Ceres CLONE 1424652-F
  misc_feature: SWISSPROT Homolog: EC 1.6.99.5 NADH dehydrogenase (quinone)
MKWEFSQANIKKVNEILSHYPSNYKQSGIIPLLDLAQQQHGGWVPVAPMDAIAKNSRGCTHQGL

SEQ ID NO: 37838 - DNA, 614 bp, Zea mays
  misc_feature: Ceres CLONE 1424656-F
  misc_feature: Translation starting site: 351
  misc_feature (46)..(46): n is a, c, t, g, unknown, or other
  misc_feature (48)..(48): n is a, c, t, g, unknown, or other
  misc_feature (306)..(306): n is a, c, t, g, unknown, or other
  misc_feature (314)..(314): n is a, c, t, g, unknown, or other
  misc_feature (319)..(319): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (401)..(401): n is a, c, t, g, unknown, or other
  misc_feature (402)..(402): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (420)..(420): n is a, c, t, g, unknown, or other
  misc_feature (421)..(421): n is a, c, t, g, unknown, or other
  misc_feature (425)..(425): n is a, c, t, g, unknown, or other
  misc_feature (437)..(437): n is a, c, t, g, unknown, or other
  misc_feature (440)..(440): n is a, c, t, g, unknown, or other
  misc_feature (441)..(441): n is a, c, t, g, unknown, or other
  misc_feature (443)..(443): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (470)..(470): n is a, c, t, g, unknown, or other
  misc_feature (472)..(472): n is a, c, t, g, unknown, or other
  misc_feature (473)..(473): n is a, c, t, g, unknown, or other
  misc_feature (486)..(486): n is a, c, t, g, unknown, or other
  misc_feature (531)..(531): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (567)..(567): n is a, c, t, g, unknown, or other
  misc_feature (568)..(568): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (593)..(593): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
gctgaatcgcggtggcggccggctctaaaaatagtggatcccccgngnctgcaggaattcgcacgagaccattacctagaacatcctaatcgaaaatttcttctcctctctgctctgttcacttcgttctagtggggagcgccgccgctgcagttgccgccgccaccagagcagtccacctcggtctgatatggcgaccgggagtggcagtgccatcgcgtccttctccgtggcggcggcagcggctgctgcttttcccgtcagggggccttgcgctcccgcttggccttggcccccctcgcaggncgcgcacnagggncgattcttaaagccttagcccttgcccccccatggaacccccaagcccccttggggggggcgggggaatnnnaaggcccggnnggnnnnnncgnnnnggcnngggngaaggttgtggncgnncnccctcnnnnnnnnnnnnnagnnncttncnntgcggagaaaggntaaggagaaagttttcctcggggaagcccgctttttcccccccgntcccgccnnnnnnnngcgnnnnnnnnncgnnnnagnntcggnnnnnnnnnntccnnnnnncnacnnnnccgcgnnnaggnnnt

SEQ ID NO: 37839 - DNA, 652 bp, Zea mays
  misc_feature: Ceres CLONE 1424665-F
  misc_feature: Encodes the peptide sequence at SEQ ID NO. 37840
aaagctggagctccccgcggtggcggccgctctagaactagtggatcccccgggctgcaggaattccaccaaacccttacctaaaacatcctaatccaaaaatcgacccagccatctcctcaccctctttcaccacacagtccgccactcctttactagcttgtgatttgtacgtcgaacatatctctggtcgggtggcggacgaccacacatggggaagggtagtgtgggtgcatcgtggtgggcgttcctcctgctcgccggcgtgctgttggtcctagcaaccacggcccgcccggacgaccgagtgatccaacggcaccgccaggacgacctgctgtggtgcaaacacgctatgccaatgccactaccgaaaggacaccccgcctaacagggaatgcgagagcaattgccgcaagcggcacccgcaagctgacgcaagagattacggcaaccgcgccgtggacccctacctctcccgctccaggacgggcgagtgccggcacctgtgcctgcgcctcctcaagggccagccgtgggagacccacgagtgcatgaggccgtgccgccgccgcgaactgaccgtctattggagcaatatacagtcgcgccatcgagagcgcttcaatgcctgtagatgtctacgccacac

SEQ ID NO: 37840 - protein, 59 aa, Zea mays
  misc_feature: Ceres CLONE 1424665-F
MGKGSVGASWWAFLLLAGVLLVLATTARPDDRVIQRHRQDDLLWCKHAMPMPLPKGHPA

SEQ ID NO: 37841 - DNA, 633 bp, Zea mays
  misc_feature: Ceres CLONE 1424667-F
  misc_feature: Encodes the peptide sequence at SEQ ID NO. 37842
  misc_feature (611)..(611): n is a, c, t, g, unknown, or other
agctccccgcggtggcggccgctctagaactagtggatcccccgggctgcaggaattcgcacgagaccattacctagaacatcctaatcgaaaacatcaacaaaatttgattttcctttcctttccttttccacccccgactattacccctcctcccactccacggagaagcgaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacacttttcattacctcgtggaagacggattcacatactgtgtttgtttgctgtgaatcggtggggcaacaattccctattgcttttcatggatagggtaagggaggattcacaaaaaggtatggtggtgggaaagctgctactgctgcanctaacagcctcaatcgaaggtg

SEQ ID NO: 37842 - protein, 70 aa, Zea mays
  misc_feature: Ceres CLONE 1424667-F
MGQQSLIYAFVARGTVILAEYTEFTGNFTTIASQCLMKLPASNNKFTYNCDGHTFHYLVEDGFTYCVCLL

SEQ ID NO: 37843 - DNA, 642 bp, Zea mays
  misc_feature: Ceres CLONE 1424668-F
  misc_feature: Encodes the peptide sequence at SEQ ID NO. 37844
aagctggagctccccgcggtggcggccgctctagaactagtggatcccccgggctgcaggaattcgcacgagaccattacctagaacatcctaatcgaaaaacatagtcgaaagctacgagcactcgccgcgcactcaccaggaaattcccaagccgccccttcccccatctctttcgcgccccatttgatcgattcctgatggcgcccaaggccgagaagaagcccgcggagaagaagccggcggaggagaaggccgacaagaagccaagggcggaaaagcgcgtgccaagcaaggagggcggcaagaagaacggaaagaagaaggcgaataacagcgtcgagacgtacaagatctacatcttcaaggtgctcaagcacgtgcacccggacattgccatctcgtccaaggccatgtccatcatgaactccttcatcaacgacatcttcgagaagctcgccgccgaggcagccaagctcgaccgctacaacaagaagcccaccatcacctcccgggagatccagacctcggagcgcctcgtcctccccggcgagctcgccaagcacgccgtctccgaaaggaccaaggcggttaccaagtttacatcctcttagggtgccaccgccgccgcacgttgctaaa

SEQ ID NO: 37844 - protein, 137 aa, Zea mays
  misc_feature: Ceres CLONE 1424668-F
  misc_feature (44)..(114): Pfam Name: Histone Pfam Description: Core histone H2A/H2B/H3/H4
MAPKAEKKPAEKKPAEEKADKKPRAEKRVPSKEGGKKNGKKKANNSVETYKIYIFKVLKHVHPDIAISSKAMSIMNSFINDIFEKLAAEAAKLDRYNKKPTITSREIQTSERLVLPGELAKHAVSERTKAVTKFTSS

SEQ ID NO: 37845 - DNA, 636 bp, Zea mays
  misc_feature: Ceres CLONE 1424669-F
  misc_feature: Encodes the peptide sequence at SEQ ID NO. 37846
tggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgatcttgtccccttcaccaacaaggtgtacaacggcagcctggacaagcggctgggcgtcaccgcgggcatctgcgtgctcatccagcacgtccccgaccgcaacg

SEQ ID NO: 37846 - protein, 132 aa, Zea mays; identical to SEQ ID NO: 15126
  misc_feature: Ceres CLONE 1424669-F
  misc_feature: SWISSPROT Homolog: EC 5.3.99.6 Allene-oxide cyclase

SEQ ID NO: 37847 - DNA, 657 bp, Zea mays
  misc_feature: Ceres CLONE 1424673-F
  misc_feature: Encodes the peptide sequence at SEQ ID NO. 37848
caagctggagctccccgcggtggcggccgctctagaactagtggatcccccgggctgcaggaattcgcacgagaccattacctagaacatcctaatcgaaaaaccggcgatccgcggacatccactgttctgacatcgtatcaccggctgcttacttgtgaacaaggctccagcatggttcgacatttggtcccttggcttccttgaagataaacttggctcccgacgacatggcccatgattctgcttcccactacaatggcaagcgacttgtcgctgtctcctcggattctttcgtgaagatgctcgcatttgtcgcgttctatgcgacgtccaaagtcctggatacgcttactggacactagggtcctgtgtggcgtgtcgctcggtgccatccatcctctggtgcattccttgctccgtgcatatatgaagacccgccagtacttcgaacgatgatgcacgatgcgacccgtcttcctttcatgtgttctgagacgacgttccactgtaatctccgtttgatgagctccaagttatgccgggctatgccctggcatgtggatactcatgcgggagaatatgcaactctgctgacgcttgctgaatgtgggttaggtattctgcaagctatcgaggacgtttgctcatgtcggg

SEQ ID NO: 37848 - protein, 44 aa, Zea mays
  misc_feature: Ceres CLONE 1424673-F
MAHDSASHYNGKRLVAVSSDSFVKMLAFVAFYATSKVLDTLTGH

SEQ ID NO: 37849 - DNA, 683 bp, Zea mays
  misc_feature: Ceres CLONE 1424674-F
  misc_feature: Encodes the peptide sequence at SEQ ID NO. 37850
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (138)..(138): n is a, c, t, g, unknown, or other
  misc_feature (140)..(140): n is a, c, t, g, unknown, or other
  misc_feature (395)..(395): n is a, c, t, g, unknown, or other
  misc_feature (468)..(468): n is a, c, t, g, unknown, or other
  misc_feature (476)..(476): n is a, c, t, g, unknown, or other
  misc_feature (505)..(505): n is a, c, t, g, unknown, or other
  misc_feature (511)..(511): n is a, c, t, g, unknown, or other
  misc_feature (539)..(539): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaactgggaactccangncggtgggcggccgctctagaactagtggatcccccgggctgcaggaattcgcacgagaccattacctagaacatcctaatcgaaaagtgtccgcaaacgattaaaaccctcccggtggcggcggctggtacagccagcggaaggtcccggcgctctcatccggtgaaaataaagaggggaaacggacaggagccgcctcaaatggacagcggaagcgattccgacggcgctcccgaggagctcactgctgtgcanggtgttgcgaagcacgaagaagacagtaaagtcgagaaagacagtgttctcagagtaacacgggaaaggaaangaaacgangaaacgttgggcctaacgaagaacatccntctaanccagaatagaaggcggccaaaggaagtngaagtatgaagatactaaaaaaagtggaggacttggaggagacaaatactttggcccgggcatgctccccacctaaaggaaattggaattccaaccaactccttggaaaaacaaaacctttcccatccaaattccgagggaaaa

SEQ ID NO: 37850 - protein, 68 aa, Zea mays
  misc_feature: Ceres CLONE 1424674-F
  misc_feature (18)..(18): Xaa is any aa, unknown, or other
  misc_feature (43)..(43): Xaa is any aa, unknown, or other
  misc_feature (45)..(45): Xaa is any aa, unknown, or other
  misc_feature (55)..(55): Xaa is any aa, unknown, or other
  misc_feature (57)..(57): Xaa is any aa, unknown, or other
MDSGSDSDGAPEELTAVXGVAKHEEDSKVEKDSVLRVTRERKXNXETLGLTKNIXLXQNRRRPKEVEV

SEQ ID NO: 37851 - DNA, 662 bp, Zea mays
  misc_feature: Ceres CLONE 1424679-F
  misc_feature (662)..(662): n is a, c, t, g, unknown, or other
ggagctccccgcggtggcggccgctctagaactagtggatcccccgggctgcaggaattcgcacgagaccattacctagaacatcctaatcgaaaaacccataatattttgaacattcaaaaacacacctagcgaagcggagtaccaacgacataacaacaatggctactaagatattatccctccttgcacttcttgccctttttgttaacgcaacaaatgcgttcattattccacaatggtcacttgctcctagtgccattattccacatttcctcacaacatttagttcaatgggcttccaacatccagctgtgcaagcctacacgttaaaacaaacgcttgcgactagcgtcttacaacaaccaattgcccaattacaacaacaatccttggcacatctaacaatacaaaccaatcgcaatgcaacagcaacagcaacaacagttcctactaccacagacccacctagccatggtgaaccctggcaccgacttgtaacaacaactggttgcatccaacccacttgctctggcaaacgcagttgcaaaccagcaacaacaacagctgcaacagtttctgccagcgctcagtcaactagccatggtgaaccctgccgccgacctacaacagcaacaactgctttcatctagctcgctcgn

SEQ ID NO: 37852 - DNA, 618 bp, Zea mays
  misc_feature: Ceres CLONE 1424688-F
  misc_feature: Encodes the peptide sequence at SEQ ID NO. 37853
  misc_feature (575)..(575): n is a, c, t, g, unknown, or other
ggagctccccgcggtggcggccgctctagaactagtggatcccccgggctgcaggaattcgcacgagaccattacctagaacatcctaatcgaaaactttttcgtcaactccacttctcttctccgcgtcacctcctcttcgccgccgccgacgcttcacccggcagccagccatggatgaggagtacgacgtgatcgtactaggcacggggctcaaggagtgcatcctcagcggtctcctctctgtagacggcctcaaggttttgcatatggacagaaatgactactatggaggagattccacctcactcaaccttaatcagctctggaagaggtttagaggggaagacaagcccccagcacatctaggtgcaagcagagactacaatgtggacatggtgccaaagtttatgatggcaaatgggacattggttcgaaccctcattcacaccgacgtgacaaagtacttgtcattcaaagctgttgatgggagctatgttttcagcaaagggaagatttacaaggtccctgccactgatatggaggctctgaagtccctttgatggccctattcnagagcgcaaagcaggaacttcttctttatgtcccagatacatg

SEQ ID NO: 37853 - protein, 129 aa, Zea mays
  misc_feature: Ceres CLONE 1424688-F
  misc_feature (1)..(130): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSL

SEQ ID NO: 37854 - DNA, 618 bp, Zea mays
  misc_feature: Ceres CLONE 1424701-F
  misc_feature (618)..(618): n is a, c, t, g, unknown, or other
aagctggagctccccgcggtggcggccgctctagactagtggatcccccgggctgcaggaattcgcacgagaccattacctagaacatcctaatcgaaaaaacatattattgagaccaactagcatcatagaaagcacaataggtgtaccaacaatggcagccaaaatattttgcttccttatgctccttggtctttctgcaagtgatgctaccacaaccattttcccacaaagctcacaagctcctataacttcctttcttaccccatacctctcaacaacgatgtcttcagtatgtgaaaacccaattcttcaacccaacaggatccaacaggcaatctcaccaggcatcttacctttatcacccttgttcctccaacaaacgtcacccctattacagcacttacctttggtgcatttgttggcacaaaacatcaaggcacaacaactacaacaacttatgctacgaaaccttgctgcctactctcagcaacaccactttcttccattcaaccaacaggctgcattaaactctgctgcttatttgcaacaacaactaccattcagtcagctagctgctgcctacccccatcaatttcttccattcaaccaactgan

SEQ ID NO: 37855 - DNA, 619 bp, Zea mays
  misc_feature: Ceres CLONE 1424714-F
  misc_feature: Translation starting site: 154
  misc_feature: Pfam Name: DUF1682 Pfam Description: Protein of unknown function (DUF1682)
tggagctccccgcggtggcggccgctctagaactagtggatcccccgggctgcaggaattcgcacgagaccattacctagaacatcctaatcgaaaagcaacccccgcctgcagcacgcgtcacgccacgccacctctccccagggtccggcgatgtcggcgccctccgacgccgcggtggcagccgcagcgcccgcatccacgaccaccgccgccgcctccagcggtgggctcaccttcaagctccacccgctcgtcatcgtgaacgtctccgaccaccacacccgcgtcaaggcccaggccgcctgctccggggacagctcttccccctcctcgtccgccccgggggccgggcagccgccgagggtgttcgggtgcgtgatcggggtgcagcttcctgatctgcttcgtgctcaactactttacggggaagcggcaaaacgagaacatcgcgctggcctgggccaccaagttcgccacgagggactccatcttcgacaagaacttcagccttcttggcacaggcgacggcaaggacacgccactcctgctcaaggaagggcaggacgtgttcaaattctacgccagtgggagacgcttctgccagggcatgctcgcc

SEQ ID NO: 37856 - DNA, 667 bp, Zea mays
  misc_feature: Ceres CLONE 1424726-F
  misc_feature: Encodes the peptide sequence at SEQ ID NO. 37857
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (345)..(345): n is a, c, t, g, unknown, or other
  misc_feature (352)..(352): n is a, c, t, g, unknown, or other
  misc_feature (427)..(427): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctgggactccccgcggtggcggccgctctagaactagtggatcccccgggctgcaggaattcgcacgagaccattacctagaacatcctaatcgaaaactctttctcttagactatctgccgctccagcctttcgctagggtttaaccaccggcggcgcgcgcgacggcggcaagatggtgcagcgtctgacctacccgcagcggcacagctatgccacgaagtccaaccagacgcnggtcgtncagacccctggtgggcagctcgtgtaccagtacacccagaagagaggcagcggggcccaagtgtcccggtgaccngggaagaagatccagggcattccccattctgagggccgctgagttccaaaaaggtccaggttggccaagaaacccgccaaaacttgtaaaccgtccccattggggggagaaccatactggggacctccctttaaagaaaagggtaaccccccgggttttcccggggtgaaaaacccaaaaaaatttgtccaaaaaggggtttttaaatttctcggagaaaccccaaaaaagaaaatttct

SEQ ID NO: 37857 - protein, 46 aa, Zea mays
  misc_feature: Ceres CLONE 1424726-F
  misc_feature (21)..(21): Xaa is any aa, unknown, or other
MVQRLTYPQRHSYATKSNQTXVVQTPGGQLVYQYTQKRGSGAQVSR

SEQ ID NO: 37858 - DNA, 671 bp, Zea mays
  misc_feature: Ceres CLONE 1424728-F
ggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctcgatgctctcccca

SEQ ID NO: 37859 - DNA, 647 bp, Zea mays
  misc_feature: Ceres CLONE 1424735-F
  misc_feature: Encodes the peptide sequence at SEQ ID NO. 37860
  misc_feature (593)..(593): n is a, c, t, g, unknown, or other
aagctggagctccccgcggtggcggccgctctagaactagtggatcccccgggctgcaggaattcgcacgagaccattacctagaacatcctaatcgaaaaaatctccttgcccgttgtgctctctctcttcattcgttcccggcctcaccccgagccagtcgtctcgctagggtttcgccgccgccgccatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacagggctgttgactctgtattaggtccccggaccatccagcatgagactcttgccacagaagctcctgctgctgcccctgctgctccagcgatgaatgctgatgcttgcagcttccattctaaggctttccaagattgtctcaacaactatgggcacgagatcagcaagtgccaagtctacctagacatgctgaacgagtgccccccgggntggtgtgtctggctaagctgcctctgggaaatatcatggaatttctttccggaa

SEQ ID NO: 37860 - protein, 115 aa, Zea mays
  misc_feature: Ceres CLONE 1424735-F
  misc_feature (56)..(97): Pfam Name: CHCH Pfam Description: CHCH domain
MVVAPCLEELGPPLLKVWRLARVVPWHRAVDSVLGPRTIQHETLATEAPAAAPAAPAMNADACSFHSKAFQDCLNNYGHEISKCQVYLDMLNECPPGWCVWLSCLWEISWNFFPE

SEQ ID NO: 37861 - DNA, 650 bp, Zea mays
  misc_feature: Ceres CLONE 1424739-F
  misc_feature: Encodes the peptide sequence at SEQ ID NO. 37862
aaagctggagctccccgcggtggcggccgctctagaactagtggatcccccgggctgcaggaattcgcacgagaccattacctagaacatcctaatcgaaaaaccctagttctttctttcctggcagcgacaactgcgcagcggcgccgccaccggacgtcagatctccgttggtgtgtttgatggacatgagcacctgtcaggtactctacggccactttctctcattaaggtagtactgagttcattgcatgactatgacttctgaagatggagacattttggctcttctgtctgacccaacccgaacggaagatcaaccagacgcttctgaatctgatgctatgttttctgcgattatgagagccattgaatcaaataagaatgtagttgaagtttcacctgacgaagctgcctgggcacattcatgcttcatgcacacttctgaactgtcatatgatgactgtggagcgatgaggagaatgctgcttgatgccctcgtaaagccaacatacagtccagtgatacttcagatagcgcacataatgcaatctcagaagacaaacctcactcccttcctgctgaaaatatttctgagcttggcgacatccggatgaagcacatgaacgatgcgcatgatgaccaggatg

SEQ ID NO: 37862 - protein, 121 aa, Zea mays
  misc_feature: Ceres CLONE 1424739-F
MTMTSEDGDILALLSDPTRTEDQPDASESDAMFSAIMRAIESNKNVVEVSPDEAAWAHSCFMHTSELSYDDCGAMRRMLLDALVKPTYSPVILQIAHIMQSQKTNLTPFLLKIFLSLATSG

SEQ ID NO: 37863 - DNA, 655 bp, Zea mays
  misc_feature: Ceres CLONE 1424740-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (520)..(520): n is a, c, t, g, unknown, or other
  misc_feature (589)..(589): n is a, c, t, g, unknown, or other
  misc_feature (611)..(611): n is a, c, t, g, unknown, or other
  misc_feature (634)..(634): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttcaaactgggactccccgcggtggcggccgctctagaactagtggatcccccgggctgcaggaattcgcacgagaccattacctagaacatcctaatcgaaaactaatcgaaaagccgcatcccttctttcattcgccgccgccgcctcctctctggctgcgtcgccatggggagaaggctgcagatgctatcgcaaaatcagaacaagcattacccccaagtcccaggaactgcccgggggggtcccttgaccccccaaaaattaggggatccccccatgtggttggcaaaaaaaaaaaaaaaggggggttttaaaaaaaaatccccccccccacggggggggggcacccccctttttttcttttttggggaaaaaaaaaaaaaaaaaaaaatcccccccccccgngggggggggctctccttttgggagaggcggcgccccccccttttttttttctcccgccccgcccgaaanaggaagttgttgttttgacccnccccccctttttttttttttttngagaaaaaaaaaaaaggaaac

SEQ ID NO: 37864 - DNA, 698 bp, Zea mays
  misc_feature: Ceres CLONE 1424748-F
  misc_feature: Encodes the peptide sequence at SEQ ID NO. 37865
  misc_feature (508)..(508): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (576)..(576): n is a, c, t, g, unknown, or other
  misc_feature (579)..(579): n is a, c, t, g, unknown, or other
gctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtggctgggtgcccggccgccatcgcgctggcgctcatggcggccgggttcgtcacctccggcggcctcggcgtcgctgngccctgtccgtgttctcctggatgtacaagtacctgacgggcaagcacccccccgcggggnnnnacanttngaccacgccaaggcgaggctgggcgtcaaggcccgcgacatcaaggatgcagcacagcaccgcatcgaccaggcgcaggggtcttgaagagaggagcacacttcaagcggaccgcgcgc

SEQ ID NO: 37865 - protein, 118 aa, Zea mays
  misc_feature: Ceres CLONE 1424748-F
  misc_feature (36)..(118): Pfam Name: Oleosin Pfam Description: Oleosin
  misc_feature (107)..(107): Xaa is any aa, unknown, or other
MADHHRGATGGGGGYGDLQRGGGMHGEAQQQQKQGAMMTALKAATAATFGGSMLVLSGLILAGTVIALTVATPVLVIFSPVAGCPAAIALALMAAGFVTSGGLGVAXPCPCSPGCTST

SEQ ID NO: 37866 - DNA, 722 bp, Zea mays
  misc_feature: Ceres CLONE 1424753-F
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (680)..(680): n is a, c, t, g, unknown, or other
aagctggagctccccgcggtggcggccgctctagaactagtggatcccccgggctgcaggaattcgcacgagaccattacctagaacatcctaatcgaaaaacaccaacaaaccaaacaccatccgccacgaccacgactccacgagagagcggaggaggagggggagcaatggcagagccgggccagcagttgctgcggtcgttcgtggaggtggcagcgggctcgcattccctatccagacctggccttcggggtcttccgcggcgggggtcgccaccgcaggctccgctccccccggtggcatcggggacttccggttgacttcgccaccgtcgcgacgcgggtttctttgaggggcccgggttctcgggttcccgggcttcccccgggagaccctcaaatttttttccccaatgggccacccgggtggggggggggggcggcccccctcaaaaaatcttttttcccaaaaaaccattttggtgggaaaccaacccccgggggaaaaaatgtgtttttccccgggggtggataccagggggggtgtcccccccccccccgcggggggggggttcaccccacttnnnnncctcttttgttttttttgggccccccctttcgggaggaacccgggggggtttttttttttttggggggggggggcccaaaacacccccncttttaaccacccaaatggtggctttttttcccctcccaaaa

SEQ ID NO: 37867 - DNA, 735 bp, Zea mays
  misc_feature: Ceres CLONE 1424755-F
  misc_feature: Encodes the peptide sequence at SEQ ID NO. 37868
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (355)..(355): n is a, c, t, g, unknown, or other
  misc_feature (359)..(359): n is a, c, t, g, unknown, or other
ctggactccccgcggtggcggccgctctagaactagtggatcccccgggctgcaggattcgcacgagaccattacctagaacatcctaatcgaaaagtgtccgcaaacgattaaaaccctcccggtggcggcggctggtacagccagcggaaggtcccggcgctctcatccggtgaaaataaagaggggaaacggacaggagccgcctcaatggacagcggaagcgattccgacggcgctcccgaggagctcactgctgtgcagggtgttgcgaagcacgaagagaccagtaaagtcgagaaagacagtgttctcagaagtacacgggaaggaaaggaacgnnnagaacgttggncccnacgaagaacatcctctaaacccagatagaaggccccaaaaggagtaaaagatgaaaatactaaaaaaggggaggagcttgagggaacaaatcctttgccggggatgcctcccactaaggaaattgaaattcagccccccgggggaaacaaaaccttccctccatttcccggggaaaaaatgttaaccaaaaggcccaagaaaaaaaaaaaaattaaaactggggggcccaaaaatttttctctaaaaaaatctcctccccccccccccggaaaaaacccccttttttttttgggaaaaaaaaaaaattttcccccccgggaaaaattttttttaaaaaaccccaaggttttctcctcccctttcttcaaaaaaatt

SEQ ID NO: 37868 - protein, 58 aa, Zea mays
  misc_feature: Ceres CLONE 1424755-F
  misc_feature (45)..(45): Xaa is any aa, unknown, or other
  misc_feature (49)..(49): Xaa is any aa, unknown, or other
  misc_feature (50)..(50): Xaa is any aa, unknown, or other
MDSGSDSDGAPEELTAVQGVAKHEETSKVEKDSVLRSTREGKERXERWXXRRTSSKPR

SEQ ID NO: 37869 - DNA, 651 bp, Zea mays
  misc_feature: Ceres CLONE 1424763-F
  misc_feature: Pfam Name: Mg_chelatase Pfam Description: Magnesium chelatase, subunit ChlI
  misc_feature: SWISSPROT Homolog: EC 6.6.1.1 Magnesium chelatase
aaagctggagctccccgcggtggcggccgctctagaactagtggatcccccgggctgcaggaattcgcacgagaccattacctagaacatcctaatcgaaaaatccaccatataattggcgtctcttctgggaacgacttcgaaatctgcgtctccttctctctcagcttcggctaccacaacattttccatctctacgatttgtgttctgtcaacgagagtcggtgaaacaacgttttatgctcgatgctcactaacgccaataaataccctgtctcgcccatatgtttctgtcatgaatgctgccacataagtcaactccactgatcaaccagtaaggaattttgattcaatcaagagtgcgaggacagcttatcctttgttgctgtagcacgcctcgacgacctaacctatgtctcttgatgaatgcgattgatcccgacatcggtggtgtgatgactctggctaactcagaaccccagaagtgctctggcgaaccgttcttactacatctcttaaccaaaattactgcagttgcacgaaatgcctacaattatgactgctgataccctgagtccacggctattaccgtttgacagagagtctactgacgagatcaagttcccgccatcgctaccaatatcaccatgg

SEQ ID NO: 37870 - DNA, 674 bp, Zea mays
  misc_feature: Ceres CLONE 1424779-F
  misc_feature: Pfam Name: Ndr Pfam Description: Ndr family
aaagctggagctccccgcggtggcggccgctctagaactagtggatcccccgggctgcaggaattcgcacgagaccattacctagaacatcctaatcgaaaaacggtataacctagaacccacgtcttcaaatagactgtcatatggtgcatttaccaccctcgaaccatagatgatttggcagagatgtcttctgccggcatcagcggatgcgtgcctacaactgaacaccatatacaaacgaatcatggacctgtatctgttcagtgtatggtgaccatgacaagcctgcccttgttacttaccccgatattgctttaaactatatgtcctgcttccaaggactattgttctgtcccgaagccgcttcgctgctgcttcataatttttgcatttaccatattagccccccaggacatgagttaggagctgctccaatttcaccaaatgctcctataccgtctgttgacgatttggcagatcaggttgcggatgtcctcgatttctttggattaggctctgttatgtgcttcggtgtcactgcaggtgcctacattctaactctgttcgcggcaaagtatagggagcgggtactaggtcttatccttgtttcacctctgtgtaaaggccccacttggactgagtggttatacagtaaggtaaacatccatctg

SEQ ID NO: 37871 - DNA, 658 bp, Zea mays
  misc_feature: Ceres CLONE 1424782-F
  misc_feature: Encodes the peptide sequence at SEQ ID NO. 37872
aaagctggagctccccgcggtggcggccgctctagaactagtggatcccccgggctgcaggaattcgcacgagaccattacctagaacatcctaatcgaaaaatcccctctcatccttatcttggcggcggcgcaagcgcaggcgagcggccgtccagtcgcgcgggcagcaggggcggccgtccgtccaggcgcaggcgagcggccgtccgtccagcgcatgctagcggccatccgtccaggcgaactgcgagcaggcgtccctccaaacgaactgcgagcgtccgtccaggcttccgtccagcgagcggcacaacttttctacgcacaacacattccaagaaccgaaaatggagagtgaaggagctggtgagcactttgtggaacaagttgatggtagtggccatgttgtgtggacttctgcaatgtccgcttacatgctcagtaacctagcaagccttgtggctgaagggatcaggacatcaacaagcttcaagaaagttcaccttaacatgtgtgctaaggctctaaatgactatttcaagatgaagctcactggagaacaagtgaagaaccatttgaggacatggaatagaagatatgcgaagataaacagacttaggaagttaagtgctgcttcttgcaacgagataactac

SEQ ID NO: 37872 - protein, 102 aa, Zea mays
  misc_feature: Ceres CLONE 1424782-F
MESEGAGEHFVEQVDGSGHVVWTSAMSAYMLSNLASLVAEGIRTSTSFKKVHLNMCAKALNDYFKMKLTGEQVKNHLRTWNRRYAKINRLRKLSAASCNEIT

SEQ ID NO: 37873 - DNA, 486 bp, Zea mays
  misc_feature: Ceres CLONE 1424790-F
  misc_feature (201)..(201): n is a, c, t, g, unknown, or other
  misc_feature (215)..(215): n is a, c, t, g, unknown, or other
  misc_feature (216)..(216): n is a, c, t, g, unknown, or other
aagctggagctccccgcggtggcggccgctctagaactagtggatcccccgggctgcaggaattcgcacgagaccattacctagaacatcctaatcgaaaaatcacactcgccaaccccgtcatcgatctcgtttcaaatccatccatcctcgtttcctccgtcccgcagcatctcaaccccatggccaagatcaagatcngggatcaatggggnnttcggcaagggatccggaaaggctggtgggccaggggtgcctctgccaaatggccacaatttccaaaccctcttccccctgagaaaaaacccctttaatgaggcccggaataaattgggagcccctctgggtgtttacaaaaaaaaaaaaactttttttccccgggggggggggagaaccccccctcgataaacggggggggggggaggaaaagtgctcaaaaaatcctcttttttttttttttttaaaaaaaaaaaaaaattttttttt

SEQ ID NO: 37874 - DNA, 708 bp, Zea mays
  misc_feature: Ceres CLONE 1424794-F
  misc_feature: Encodes the peptide sequence at SEQ ID NO. 37875
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (303)..(303): n is a, c, t, g, unknown, or other
  misc_feature (305)..(305): n is a, c, t, g, unknown, or other
  misc_feature (339)..(339): n is a, c, t, g, unknown, or other
  misc_feature (348)..(348): n is a, c, t, g, unknown, or other
  misc_feature (432)..(432): n is a, c, t, g, unknown, or other
  misc_feature (433)..(433): n is a, c, t, g, unknown, or other
  misc_feature (473)..(473): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagctgggactccccgcggtggcggccgctctagactagtggatcccccgggctgcaggaattcgcacgagaccattacctagaacatcctaatcgaaaacatccgcacgtccgccttgatccggcaaatggcgtcgccggcgcggcggctcctgcagaccaactccgtgcagtacccgacgctccccgcggccgaccngncgagcgcgctggccgtcgactccgacgtggtggntcatctcgncgcgctcctctgcgcgctcatctgcgtcgtgggggctggccctcgtgggccgggtggggggggtcccggggccggggcccgcgnncgcggcaggaagggggctcaggaaaaaagggcctcagggnccttccccaaacttccgtaacaaagaaacccggtggggccccggtccggggcccgggaacggggcccgggaaacggggggccaaaaatccctgtcgaaaatgggccacctgccggttggaaaatcccccccccccgaagagaaggcccccgggctttccccaaaagaggggccccccccttttccacagggcccggggatagaaaaccatcgggttgccccgcccccattcccct

SEQ ID NO: 37875 - protein, 86 aa, Zea mays
  misc_feature: Ceres CLONE 1424794-F
  misc_feature (24)..(24): Xaa is any aa, unknown, or other
  misc_feature (25)..(25): Xaa is any aa, unknown, or other
  misc_feature (36)..(36): Xaa is any aa, unknown, or other
  misc_feature (39)..(39): Xaa is any aa, unknown, or other
  misc_feature (67)..(67): Xaa is any aa, unknown, or other
  misc_feature (81)..(81): Xaa is any aa, unknown, or other
MASPARRLLQTNSVQYPTLPAADXXSALAVDSDVVXHLXALLCALICVVGAGPRGPGGGGPGAGARXRGRKGAQEKRASGXFPKLP

SEQ ID NO: 37876 - DNA, 641 bp, Zea mays
  misc_feature: Ceres CLONE 1424800-F
  misc_feature: Translation starting site: 261
  misc_feature: SWISSPROT Homolog: EC 1.1.1.22 UDP-glucose 6-dehydrogenase
  misc_feature (406)..(406): n is a, c, t, g, unknown, or other
ctggagctccccgcggtggcggccgctctagaactagtggatcccccgggctgcaggaattcgcacgagaccattacctagaacatcctaatcgaaaaagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagaaacattgaggtcgtcgtcgttgacatctccaagccccgcattgaggcctggaacagtgacaccctgccnatctacgagcctggtctcgatgatgttgtgaagcagtgcaggggcaggaacctctttctcagcactgatgttgaggaagcacgtcgctgaggctgacattatcttttgtcctcggtgaaaaccccccacccaagaaccccgggggcttttggaacttgggaaagggtttcccacaccctccccccttctgggggaagacgcccccccccccccccaattttgggggggggtcttc

SEQ ID NO: 37877 - DNA, 666 bp, Zea mays
  misc_feature: Ceres CLONE 1424801-F
  misc_feature: Encodes the peptide sequence at SEQ ID NO. 37878
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (175)..(175): n is a, c, t, g, unknown, or other
  misc_feature (178)..(178): n is a, c, t, g, unknown, or other
aaaagctggagctcaccgcggtggcggccgctctagaactagtggatcccccgggctgcaggaattcgcacgagaccattacctagaacatcctaatcaaaaaaagtcgaagcaccgaatctactgcccctcccacctctcacacgtacgtagtgtgtgtgtgtnnnannnnacnccnacaagatcactggtcgggtggcggacaaccacacatggggaagggtagtgtgggtgcatcatggtgggcgttcgtccatggtcgccggcgtgctgctggtcgtagcagccacgaccggggcggatgacggaatggtcgaacgggaccgcaaggaggacctgcggcggtgcaagcaggcgtgcaagaggcagtacagaaaggacaccacgcggaagagggaatgcgagagcgagtgcccccagcggcaccagcaagctgacacgggcgaggactgcgacagcggcgtggacgactacgtctcccactccgagaggggcgagtgccagcgccagtgcctgcgccgcaactagggccagccgtgggagacccaggagtgcatgatgcagtgccgccgccgcggactggccgtccacatggagcaagagtacggccgcggcagcgagagcgcggacaagagccgggagaggtgcgagcgccaccaccgcggg

SEQ ID NO: 37878 - protein, 90 aa, Zea mays
  misc_feature: Ceres CLONE 1424801-F
MVAGVLLVVAATTGADDGMVERDRKEDLRRCKQACKRQYRKDTTRKRECESECPQRHQQADTGEDCDSGVDDYVSHSERGECQRQCLRRN

SEQ ID NO: 37879 - DNA, 600 bp, Zea mays
  misc_feature: Ceres CLONE 1424803-F
  misc_feature: Encodes the peptide sequence at SEQ ID NO. 37880
aaagctggagctccccgcggtggcggccgctctagaactagtggatcccccgggctgcaggaattcgcacgagaccattacctagaacatcctaatcgaaaaaaaaatatacgtcggaataaaccgcagcaaatcttcctccggcaccgagcagcgcccaaatccggcgaatccgctgctccgaatgggctcacgtatacaatgccccggaccgtggacgaggtgttacggcacttcaagggccgtcgtgccgggataatccgcgcactcaccactgatgcggatgatttcttcaagcgatgcgacccggaaaaacaacacttgtgcctgtatgggtttcctactgagagctggcaagtaaatttgcatgctcaacaggtgccacctgaactcccacaacatgcattacgcctaaactttgcaagatatggaatgacaggaaaaagagtggttgtccatggttgctgcacacatcgatgcatggatactttctgttgcatgttacttcgacgctcggttcgggatcactagaatgacaggaagcgcctctatcgtttgattgaggaacttcccatgcgcctctcaagattgttactgggg

SEQ ID NO: 37880 - protein, 109 aa, Zea mays
  misc_feature: Ceres CLONE 1424803-F
MPRTVDEVLRHFKGRRAGIIRALTTDADDFFKRCDPEKQHLCLYGFPTESWQVNLHAQQVPPELPQHALRLNFARYGMTGKRVVVHGCCTHRCMDTFCCMLLRRSVRDH

SEQ ID NO: 37881 - DNA, 632 bp, Zea mays
  misc_feature: Ceres CLONE 1424808-F
  misc_feature: Encodes the peptide sequence at SEQ ID NO. 37882
  misc_feature (1)..(1): n is a, c, t, g, unknown, or other
  misc_feature (526)..(526): n is a, c, t, g, unknown, or other
naaagctggagctccccgcggtggcggccgctctagaactagtggatcccccgggctgcaggaattcgcacgagaccattacctagaacatcctaatcgaaaactggtaaaactttgatggctcgtgcctgtgcagcacagaccaatgccactttcctcaaattggcaggccctcaattggtccagatgtttattggagacggagcaaaacttgttcgtgatgcctttcaactagcgaaagataaagctccgtgtatcatcttcattgatgagatcgatgcaattggtacaaagcgttttgacagtgaagtaagcggagacagggaagtgcagaggactatgttggagctactcaatcagcttgatggattcagtagtgatgagcgtattaaggtgattgcagctactaaccgagcagatattctggacccagcacttatgcgttctggtccgctagacaggaagattgatttccccctcccacagaagaaagcagagccggaatcttaccgatccactcgagggngaatgatgttcaccccgaacgtcactttgaaggagcttgcgaaatccacagatgatttccatgggggctccactgaaaccattattggtaaagggcttttaagttt

SEQ ID NO: 37882 - protein, 171 aa, Zea mays
  misc_feature: Ceres CLONE 1424808-F
  misc_feature (1)..(170): Pfam Name: AAA Pfam Description: ATPase family associated with various cellular activities (AAA)
  misc_feature: SWISSPROT Homolog: EC 3.6.4.3 Microtubule-severing ATPase
  misc_feature (137)..(137): Xaa is any aa, unknown, or other
MARACAAQTNATFLKLAGPQLVQMFIGDGAKLVRDAFQLAKDKAPCIIFIDEIDAIGTKRFDSEVSGDREVQRTMLELLNQLDGFSSDERIKVIAATNRADILDPALMRSGPLDRKIDFPLPQKKAEPESYRSTRGXMMFTPNVTLKELAKSTDDFHGGSTETIIGKGLLS

SEQ ID NO: 37883 - DNA, 652 bp, Zea mays
  misc_feature: Ceres CLONE 1424816-F
  misc_feature: Encodes the peptide sequence at SEQ ID NO. 37884
  misc_feature (652)..(652): n is a, c, t, g, unknown, or other
aaaactggagctccccgcggtggcggccgctctataactagtggatcccccgggctgcaggaattcgcacgagaccattacctagaacatcctaatcgaaaaacgggctcatctcgctttggatcgattggtttcttaactggtgagggactgagggtctcggagtggattgatttgggattctgttctaagatttgcggacggcggcaatggcgaccgcgggcaaggtgatcaagtgcaaagctgcggtggcatgcgaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggatgtatcatatagagtgttcgacgaggtgtgactgacgtagctccgggcgaccatgtccttcctgtgatcaatggggagtgcaatgagtgtgcccactggcagtcggcacagacaacatgggtgatctgctcaggatctacaccgaccgccgtgtgatgattgtcgatggcaatgctcggtttttcattcttgggaaacctaatctacacttttgttgggacttcccn

SEQ ID NO: 37884 - protein, 75 aa, Zea mays
  misc_feature: Ceres CLONE 1424816-F
  misc_feature: SWISSPROT Homolog: EC 1.1.1.1 Alcohol dehydrogenase
MATAGKVIKCKAAVACEAGKPLSIEEVEVAPPQAMEVRVKILFTSLCHTDVYFWEAKGQTPVFPRIFGHEAGCII

SEQ ID NO: 37885 - DNA, 680 bp, Zea mays
  misc_feature: Ceres CLONE 1424821-F
  misc_feature: Translation starting site: 233
  misc_feature (414)..(414): n is a, c, t, g, unknown, or other
  misc_feature (415)..(415): n is a, c, t, g, unknown, or other
  misc_feature (447)..(447): n is a, c, t, g, unknown, or other
  misc_feature (465)..(465): n is a, c, t, g, unknown, or other
aaagctggagctccccgcggtggcggccgctctagaactagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgtgaaagttttgacagcatgggactggcagagaaccttctgagaggcatctatgcctatgggtttgagaagcatcnngctatcagcaaagggaatagtcccctctgcangggcttgacgtgattcancaagctcagtctggactggaaaaacagctaccttctgtctggaatcttgcaccaacttgataagggattgggtgaatgccaggcattggttctttgccccaacccgaggacttgctcaacaatttgaaaagggtttccttgcccctgggggaaaattttggggtcaaaaaagcatccccggttggggggaaaatttttgttccgagagaacaaaa

SEQ ID NO: 37886 - DNA, 601 bp, Zea mays
  misc_feature: Ceres CLONE 1424823-F
  misc_feature: Encodes the peptide sequence at SEQ ID NO. 37887
aagctggactccccgcggtggcggccgctctagaatagtggatcccccgggctgcaggaattcgcacgaagaaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaagaatgtggccattacggtggttcttacaaggtgacaaaaggtttggctgatacgtttggagaccttcgagttcctgacaccccctattgcgaaactcctttactggcatggaatttgagcgggaatgaaagggctgaggcccgtctttgaaagcatgaactgggattctggccccttcttaacaacagactcaaaatact

SEQ ID NO: 37887 - protein, 137 aa, Zea mays
  misc_feature: Ceres CLONE 1424823-F
  misc_feature: SWISSPROT Homolog: EC 1.2.4.1 Pyruvate dehydrogenase (acetyl-transferring)
MATAFSLRAAAPATAPRAVSRSTSAARVVPVASALAGRGRLVARAAVTAKADVPSSTSDGHEVLLFEALREALMEEMELDPTVCVFGEECGHYGGSYKVTKGLADTFGDLRVPDTPYCETPLLAWNLSGNERAEARL

SEQ ID NO: 37888 - DNA, 867 bp, Zea mays
  misc_feature: Ceres CLONE 1424834-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (34)..(34): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (308)..(308): n is a, c, t, g, unknown, or other
  misc_feature (316)..(316): n is a, c, t, g, unknown, or other
  misc_feature (343)..(343): n is a, c, t, g, unknown, or other
  misc_feature (397)..(397): n is a, c, t, g, unknown, or other
  misc_feature (407)..(407): n is a, c, t, g, unknown, or other
  misc_feature (422)..(422): n is a, c, t, g, unknown, or other
  misc_feature (464)..(464): n is a, c, t, g, unknown, or other
  misc_feature (476)..(476): n is a, c, t, g, unknown, or other
  misc_feature (730)..(730): n is a, c, t, g, unknown, or other
  misc_feature (807)..(807): n is a, c, t, g, unknown, or other
  misc_feature (867)..(867): n is a, c, t, g, unknown, or other
nnnnnnnnccccnnnnnaacccggtttccttttntnccnnnnnnnnaaaactggaagtccccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgggttcaatcaaagcttaattaggctccctctacatctgatccagctaagtanctagccancactacaaaagggcgtggcaagaatcnggagagagatagcaggggggctagctagctaaccttctgcgacaaaaaatgggncggaaattgnaaggaacatggtggnggccggttcttgtggctcagccgcatcgtggacatgattcgncatttttctttncctagctgggaacctggaaccacttcattcagcgggccagaaccaacctacccccggcttgggccgggcaaaccggggcggagggttacaactgccctgggggtttcgcccattcccgtggggcccggcgtagtagagggatcgcggccgtgcaaaagttaggcgggggggtggagacaaataggcgggccccttggcggcacactaaagagccgtgtggacacgaggggggccgggggcggtcggggtcatgncggcctggggcgccgtgacgggtcggtcggccgcgattcagggcgtggagcgagcccagggaggatcaccccgttgnggcgggacccccggcgcattcggagccttgaagcggtggccggaacgccgcatggacaan

SEQ ID NO: 37889 - DNA, 601 bp, Zea mays
  misc_feature: Ceres CLONE 1424837-F
aaagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctcccacatccgattcccccagtctgaaatcctttttgcaacacccctctttttggggggggaagggggcaaaaatttccccccccacacaaaaattccccaaacccttttttttttttctccccccgcggggggggaataattaaa

SEQ ID NO: 37890 - DNA, 708 bp, Zea mays
  misc_feature: Ceres CLONE 1424839-F
  misc_feature: Encodes the peptide sequence at SEQ ID NO. 37891
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaaccagacagagaatactctcgctcccggatcaaagaaaccaatccattccattccacacaaagctgggctcacgcaaaccaaaccaatgtgcttccgacagcaacggctggctgacagagtaccgtcgaccctttctcgaagatgcaggagccttccatccagcccccgtcggcgactttctccctcaacgtcgggctgactctcatgctccggagcggggtcatcatgaacgtttcgacccctcagaaggcccgcctctttgaggatgccctcgcttacccccaggatggaccaggatcaggctccccgccaacatcacgctccatgctgacgatggcgcgcatgacgaacccgctcctcatcttctgacatcatgaactctcccaccgtcccagtcatatgccatagcccgcatcgggcacattcttgtacgcccccatcgctgatgtcaagacgccccgacactacgtactacagctaggtgctaacgccttcagacaaagcgcaccacatccacgagaagagattctgctatcctcttcgtatcgcagatgccgcnacatcccgcgagagactgctcaagattacgatagagcaccgtctctgatcgt

SEQ ID NO: 37891 - protein, 75 aa, Zea mays
  misc_feature: Ceres CLONE 1424839-F
MQEPSIQPPSATFSLNVGLTLMLRSGVIMNVSTPQKARLFEDALAYPQDGPGSGSPPTSRSMLTMARMTNPLLIF

SEQ ID NO: 37892 - DNA, 430 bp, Zea mays
  misc_feature: Ceres CLONE 1424842-F
ggagcccccgcggtggcggccgctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctccggccccgcgcgcgcacggtgaaacgacgagccctcgtgaatggtgggagccgcgcgacgtcgtccgctcgaagccccagcggaaggagcctcccttcccggctttcggttactgctggaggggtgggaccccccttgatttgggtccccccccagaacccgccccccccgggcctcttaagaaaaaacccaccggccccccggg

SEQ ID NO: 37893 - DNA, 634 bp, Zea mays
  misc_feature: Ceres CLONE 1424845-F
aaactggagctccccgcggtggcggccgctctagaactagtggatcccccgggctgcaggaattcgcacgagaccattacctagaacatcctaatcgaaaaaccgccaaccccaccacgcggaccggcgccaccaagctgcctctctcccttgcacgcgcatgtgtttcatcttcctcacgatccgattccggcccagcccacctttccggagctcctctcccgatgactactacggccgctgctccgatccccaaccgtgagtcactcgatggcagccaccgcgcgcggctcctagagccggcaccccaagctggtatcttcttgggaacgtgggtcccgagcagacttcctgcgcctccgataagtgagacgcagctcgtcgagtatcactagtaccccaacgaagcaggtttcttctcgatgactctggaactgaacgacgagacagtgaagtacgacatatggacaccgtgttgcatgactgatccacagcttgtgtccatgtattaccgatgcgctgctggtgacatagatgactgccactgccgaagacggactcctttcgcatgagaacagataggtcaatatcatcatggccagaaactcatatctatagtggcaattgccttaag

SEQ ID NO: 37894 - DNA, 907 bp, Zea mays
  misc_feature: Ceres CLONE 1424852-R
accgggccccccctcgaggtcgacggtatcgataagcttttttttttttttttttcgtgataaacatatgaatattaataggatttatattacattgataccttcgacttgtttgaaggtgctgatgcgagaatgattacaatccaacgtaaacggtacgtggtactattcaccaatttataggcacgggacgcaacccggataacaatacatttatgaccttaacatatacacataatcgtaacataaatcaccagggatcaactagtcttttcttcttcggctcggcattatgcttgaccttcgttgctatcctaagttgaagctgttatccttcagttgtagcttccgcatttcgttgtttatcgttttcaaacagggtcttcgttatcgagggacccctcgaagacccttccgaaagaggaaaggcccccaacagcccttgaaccttggtcgggccccgggtcttctcgattatttggaaaaagggggaggggattcaccccccgcccatttgccgcaaccctaaaaccttaaaaaaaaacccttttgccacaaaaaaaaatggaaaaaattccctcccaaccccctaaaactcccaaaagggcccacataaaaatttccccccatttttcggggccccaaaataaccccggtggaagaaagcccccccccaataggttgggccccccccaaaacccgagaaaaaaaaacgggggggagggggggcccccgcgcgaaaaaatgggggctctttcgaaaattttttttggtccccaaaaatgggaaaaaaaaagtggcgcccctggttttttttccccaaataaaaaaggtgggggaacccagcccatatgtgggtaaattagaggccgccgccgggtggcgcctaaaattactctctttctcc

SEQ ID NO: 37895 - DNA, 655 bp, Zea mays
  misc_feature: Ceres CLONE 1424859-F
  misc_feature: Encodes the peptide sequence at SEQ ID NO. 37896
  misc_feature (536)..(536): n is a, c, t, g, unknown, or other
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaacacggagtgccggaggagctgatgggcggcatgctccgcggggtgcgccagttcaacgagggcccccgtggaggcgaagcangcgctctactcgagggacctcgctcgcaacctgcggctcgccttcaacttcgacctctttcaggctgctgcggccgaactggcgcgacacgctcctctgcgaggtggctcccaaaccgc

SEQ ID NO: 37896 - protein, 109 aa, Zea mays
  misc_feature: Ceres CLONE 1424859-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNTECRRS

SEQ ID NO: 37897 - DNA, 617 bp, Zea mays
  misc_feature: Ceres CLONE 1424864-F
  misc_feature: Encodes the peptide sequence at SEQ ID NO. 37898
  misc_feature (340)..(340): n is a, c, t, g, unknown, or other
  misc_feature (394)..(394): n is a, c, t, g, unknown, or other
  misc_feature (405)..(405): n is a, c, t, g, unknown, or other
aaagctggagctcaccgcggtggcggccgctctagaactagtggatcccccgggctgcaggaattcgcacgagaccattacctagaacatcctaatcgaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgacacctccggttcacctgcccactccggtgcatctcccatcgncagtccacctgcccgcgacagtccaactgcccacgtcgggtcatgtgccgccgncggatcatctngccggcgcaccatggcactaccctactcaacgccccggtcttaagctcattcccagccaacccatggcggtgcaaagcccacttccaacccttcccattgggggaacctgggggattgccccccccttcccgggcaaggcccaagttttaaaggtctgggggcccaaaggaaccccctattgtcctcaagcaaaatttcccaaaatttgttc

SEQ ID NO: 37898 - protein, 148 aa, Zea mays
  misc_feature: Ceres CLONE 1424864-F
  misc_feature (57)..(57): Xaa is any aa, unknown, or other
  misc_feature (75)..(75): Xaa is any aa, unknown, or other
MRVLLVALALLALAASATSTHTSGGCGCQPPPPVHLPPPVHLTPPVHLPTPVHLPSXVHLPATVQLPTSGHVPPXDHLAGAPWHYPTQRPGLKLIPSQPMAVQSPLPTLPIGGTWGIAPPFPGKAQVLKVWGPKGTPYCPQAKFPKIC

SEQ ID NO: 37899 - DNA, 673 bp, Zea mays
  misc_feature: Ceres CLONE 1424868-F
  misc_feature: Encodes the peptide sequence at SEQ ID NO. 37900
aagctggagctccccgcggtggcggccgctctagaactagtggatcccccgggctgcaggaattcgcacgagaccattacctagaacatcctaatcgaaaaatcccctctcatccttatcttggcggcggcgcaagcgcaggcgagcggccgtccagtcgcgcgggcagcaggggcggccgtccgtccaggcgcaggcgagcggccgtccgtccagcgcaggctagcggccatccgtccaggcgaactgcgagcaggcgtccctccaaacgaactgcgagcgtccgtccaggcttccgtccagcgagcggcacaacttttctacgcacaacacattccaagaaccgaaaatggagagtgaaggagctggtgagcactttgtggaacaagttgatggtagtggccatgttgtgtggacttctgcaatgtccgcttacatgctcagtaacctagcaagccttgtggctgaagggatcaggacatcaacaagcttcaagaaagttcaccttaacatgtgtgctaaggctctaaatgactatttcaagatgaagctcactggagaacaagtgaagaaccatttgaggacatggaagagaagatatgcgaagataaacagacttaggaagttaagtgctgcttcttggaacgaaataactacatgatcactcttgatc

SEQ ID NO: 37900 - protein, 103 aa, Zea mays
  misc_feature: Ceres CLONE 1424868-F
MESEGAGEHFVEQVDGSGHVVWTSAMSAYMLSNLASLVAEGIRTSTSFKKVHLNMCAKALNDYFKMKLTGEQVKNHLRTWKRRYAKINRLRKLSAASWNEITT

SEQ ID NO: 37901 - DNA, 660 bp, Zea mays
  misc_feature: Ceres CLONE 1424869-F
  misc_feature: Encodes the peptide sequence at SEQ ID NO. 37902
  misc_feature (463)..(463): n is a, c, t, g, unknown, or other
  misc_feature (485)..(485): n is a, c, t, g, unknown, or other
  misc_feature (540)..(540): n is a, c, t, g, unknown, or other
caaagctggagctccccgcggtggcggccgctctagaactagtggatcccccgggctgcaggaattcgcacgagaccattacctagaacatcctaatcgaaaacccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccggtggcgtcctgggcgagatgcaaggtacaagaagactgagatctgccagacatgttgcaagctaaagaatgtctgccaggtctgcctgctggatctttgatatggtctgccctgtcagggtcgagatacagcactctctatcattnccaatgatgcatttcccaggantgatgtcattcgcgaattttttggcaaaaacatgatagggagggcccagactggnataaactatgaattctcccaggggagaggcccgccaatgggaacatttttgaagctcccggggaacccccctttttcagggggaacgaacccggtgttgggttttttttggggagggggg

SEQ ID NO: 37902 - protein, 87 aa, Zea mays
  misc_feature: Ceres CLONE 1424869-F
MAHRLLRDAQADGWERSDFPIICESCLGDNPYVRMLRAEYDKECKICARPFTVFRWRPGRDARYKKTEICQTCCKLKNVCQVCLLDL

SEQ ID NO: 37903 - DNA, 648 bp, Zea mays
  misc_feature: Ceres CLONE 1424882-F
aagctggagctccccgcggtggcggccgctctagaactagtggatcccccgggctgcaggaattcgcacgagaccattacctagaacatcctaatcgaaaaacaatgagtccgcgcccacggccgaggcagctgcaggcagcggcccgtccggcggagaagggcggaagggcaaggcgcccaagggcgggcccaagaacggcaagttccggtaccgcggcgtgcggcaccggacctggggcaagtgggtggcggagatccgcgagccgcggaagcgctcccgcaagtggctcggcaccttcgccaccgccgaggacgccgcgcgcgcctacgaccgcgccgcgctcctcctctacgggccccgagcgcacctcaacctcacctccccaccgccgcctacgctcgccgcgccgcgctcgcacccgcactcctcctccgccacgtcgtcggccccgccaacgctccgcccgctccctgccgagcccgccactgcaccagctctccagcgatggtgctcctgcaccgaatttccactaccacaacaggttccagcgccgtctcttgccccagccgacaccgacactatactacgcccactcggccactgcgtccacagtgaccaccagtgtgcccacacgtgatgcggtcc

SEQ ID NO: 37904 - DNA, 649 bp, Zea mays
  misc_feature: Ceres CLONE 1424883-F
  misc_feature: Encodes the peptide sequence at SEQ ID NO. 37905
aaaactggagctccccgcggtggcggccgctctagaactagtggatcccccgggctgcaggaattcgcacgagaccattacctagaacatcctaatcgaaaagacgctcgacgcctctcctcctctcctcccccacccgtccatcgcccctccctccggtctgcgctcccacggcctcacccctgcgcccccgccgattcgcatcgccctttgttggaaggaacgatggagcagaccttcatcatgatcaagcccgacggcgtccagcggggcctgatcggggacatcatcagtcgcttcaagaagaaagggttctacctcaaggggatgaagttcatgaacgtggagagatccttcgcgcagcagcactacgctgacctttccgacaagcctttcttccccgggttggtggagtacatcatttacgagcccgtggaggctatggtgtgggaggggaaggacgtcatgttgactgggcgtatgatcattggggccaccagggccttgggagcagcccccggtaccattcgtggggactacgccctggaagtcggacagggtacatccctttcgttggactccatcaattgtgctttgctgcgaatgtttaggttggacacttaattagcctgctctacgagtgactcgg

SEQ ID NO: 37905 - protein, 132 aa, Zea mays
  misc_feature: Ceres CLONE 1424883-F
  misc_feature (2)..(131): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFKKKGFYLKGMKFMNVERSFAQQHYADLSDKPFFPGLVEYIIYEPVEAMVWEGKDVMLTGRMIIGATRALGAAPGTIRGDYALEVGQGTSLSLDSINCALLRMFRLDT

SEQ ID NO: 37906 - DNA, 673 bp, Zea mays
  misc_feature: Ceres CLONE 1424891-F
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaaacctttccatcctatcattcatcctactcgctccctctccaactcgaccgccccgccgccggccgccggccgccatctcccgccgccgaccacccccgacccaccggccgcgcccagccccaactcgcccccgttgctgtccttgtgtcgctgtccccgcccgcgttgcgcctggattgcactcagccttggccgcaatccatccgtgctttccggcgctacccaccacacatcgagttgtttgattttcgattgattcgcccgaagagggcaggccggccgacgaggtaagggtgcggtgcgaagcgttggtcagatgccccagtaccttgcggtcggcgtgctacacggagtgtgtgaactgtgaagccgccggcgcagctagctttggcatgagcacaaccgcacgaggcaagctcaggtaatcagctatccatgttgttacgtctgcacgtaggtttcgatagtccagcagctactgctccacactcaggatgtgcgaaggacatgctaattcgactgtgttttcaaaccctgagaaaaactaagctatctactgggcattatgaaan

SEQ ID NO: 37907 - DNA, 606 bp, Zea mays
  misc_feature: Ceres CLONE 1424906-F
  misc_feature: Encodes the peptide sequence at SEQ ID NO. 37908
aagctggagctccccgcggtggcggccgctctagaactagtggatcccccgggctgcaggaattcgcacgagaccattacctagaacatcctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggctgcactccccgccgacgccttcgccaccgcgctggtcatcttcctcggcgactacaacgatcgcggcccgcacacccgcagggtcctcgacttcctcctcgcgctcccgacgcgctaccccgcgcagcgccacgtcttcctctgcggcaaccacgacctcgcctttcgcggcgtcgtcggggcgctgccgccgccgcccgacggctcccgttctcggccactgggacgagtacttccccacgaggagccggaggggtgttccccgggccgggattcaaggcatgcacttcagggaaggcggggggccgggtcctcaaggaa

SEQ ID NO: 37908 - protein, 139 aa, Zea mays
  misc_feature: Ceres CLONE 1424906-F
  misc_feature: SWISSPROT Homolog: EC 3.1.3.16 Phosphoprotein phosphatase
MSAPSAPPRTVICVGDVHGYITKLESLWSNLQAALPADAFATALVIFLGDYNDRGPHTRRVLDFLLALPTRYPAQRHVFLCGNHDLAFRGVVGALPPPPDGSRSRPLGRVLPHEEPEGCSPGRDSRHALQGRRGAGSSR

SEQ ID NO: 37909 - DNA, 494 bp, Zea mays
  misc_feature: Ceres CLONE 1424909-F
  misc_feature (235)..(235): n is a, c, t, g, unknown, or other
  misc_feature (242)..(242): n is a, c, t, g, unknown, or other
  misc_feature (455)..(455): n is a, c, t, g, unknown, or other
caaagctggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactngctcgantcgccatgggccgcccgcgctcaggttgcccggcatccgtcagggtctcgggcccccgccgccccgggggctcccccaaggtgcgtcaggctcccaaatcttcccggggaaacggggcccgggaaaacccccaaaggggggggttccccggggggggggtccccttttttctcccccaaaacccccggggggggcaaaaaaaaaaaaccccgnggcccaaaaaaaaaaggggggtgaagagagacttttttt

SEQ ID NO: 37910 - DNA, 693 bp, Zea mays
  misc_feature: Ceres CLONE 1424910-F
  misc_feature: Encodes the peptide sequence at SEQ ID NO. 37911
  misc_feature (391)..(391): n is a, c, t, g, unknown, or other
  misc_feature (404)..(404): n is a, c, t, g, unknown, or other
  misc_feature (405)..(405): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcgnaagaaggaatgcnnagagcgagtgccgcgagcggcaccagcagctgaacccggcaaagacggcaacaggggctggaaccctacctctccccctccggaagggcaagtgccggcccaattccctggcccccccaaagggcccccggggaaacccccgagtgctttgagggggtcccccccccggaaatgggcctcaaattgaaaaaaaaaaacgggcccgcaacaaaaacccgggaatttccgcgagaggggcaacccccccccccgggggagggggggaaagaaccccctcctaaaaataaa

SEQ ID NO: 37911 - protein, 125 aa, Zea mays
  misc_feature: Ceres CLONE 1424910-F
  misc_feature (64)..(64): Xaa is any aa, unknown, or other
MGKGSVGASWWAFLLLAGVLLVVAATAGAEDGVVERDRKEDLRWCKQACEWQYGKDTPRKKECXERVPRAAPAAEPGKDGNRGWNPTSPPPEGQVPAQFPGPPKGPPGKPPSALRGSPPRKWASN

SEQ ID NO: 37912 - DNA, 616 bp, Zea mays
  misc_feature: Ceres CLONE 1424913-F
  misc_feature: Encodes the peptide sequence at SEQ ID NO. 37913
  misc_feature (381)..(381): n is a, c, t, g, unknown, or other
ctggagctccccgcggtggcggccgctctagaactagtggatcccccgggctgcaggaattcgcacgagaccattacctagaacatcctaatcgaaaaactcttaccgccagccccacatcacggagcatcccccttaataacagcaaactaccacacccatgtccacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtcccggccgctgccatgggcaacggcgggcgccgcccccaccgccctcgaatgcggggtcccagaangaagttgctcatctccgactcccaggaagaatctcgcgggtttcccctggcgaaataacacctgcgaaactttcggaaaaatttcccggcccaaaaaggggggcccttccccggccgggcttcttggggggacccccccctcggggcccctcaggaactttacgggaacccccctacccggatttcatgggactggggacaatggggccccctttctggggggaaaaaaaagggc

SEQ ID NO: 37913 - protein, 92 aa, Zea mays
  misc_feature: Ceres CLONE 1424913-F
  misc_feature (74)..(74): Xaa is any aa, unknown, or other
MSTSVSAAAVAALVPPLTGRRSPPASRVPQICRRRIRSKPRIFSSSPSFPIVPAAAMGNGGRRPHRPRMRGPRXKLLISDSQEESRGFPLAK

SEQ ID NO: 37914 - DNA, 716 bp, Zea mays
  misc_feature: Ceres CLONE 1424914-F
  misc_feature: Encodes the peptide sequence at SEQ ID NO. 37915
aagctggagctccccgcggtggcggccgctctataactagtggatcccccgggctgcaggaattcgcacgataccattacctagaacatcctaatcgaaaaactcccggaggccgtcgcccaccaccggccactctacggctccacgcaggcacgtcctgctatggtgtccgaggtgatggcaatcaaaacttcgtgggtggtgaggtcacattaagaaggtgtcgatcctaaaccggcaggcagcgcaggccctccccgcaagggaaatgactatcctcagagaggcctacatgagcgatgaaggacaacctccctatctacatgaacgaggttattccagaccttttcgaagaggatgaatacaaacaacatctacgcccagatgacgcacaacattgtaatgctgtactcgaaaggaacatcactacattgtttgtgactgaaatgaccacaagctcgatgctaactctcaagaacttcttagatacaaatgtcgcaattaactatcctactgacaatggtccactgatccctcccttccgtggtgagcatgctctcagacgttataacactcgttgaaagcagctcattgcttgcaaactatgcaaagctatgtgcacagggcaggcacctactattgaggctaaagcaagtgaagaaagaagccggccgatccacaacctacgatattgacatgacccaaagcgtttacag

SEQ ID NO: 37915 - protein, 93 aa, Zea mays
  misc_feature: Ceres CLONE 1424914-F
  misc_feature: SWISSPROT Homolog: EC 1.6.5.3 NADH dehydrogenase (ubiquinone)
MKDNLPIYMNEVIPDLFEEDEYKQHLRPDDAQHCNAVLERNITTLFVTEMTTSSMLTLKNFLDTNVAINYPTDNGPLIPPFRGEHALRRYNTR

SEQ ID NO: 37916 - DNA, 710 bp, Zea mays
  misc_feature: Ceres CLONE 1424915-F
  misc_feature: Encodes the peptide sequence at SEQ ID NO. 37917
  misc_feature (595)..(595): n is a, c, t, g, unknown, or other
  misc_feature (664)..(664): n is a, c, t, g, unknown, or other
aagctggagctccccgcggtggcggccgctctagaactagtggatcccccgggctgcaggaattcgcacgagaccattacctagaacatcctaatcgaaaaaagctcaccagagcagagaaactcgcacgcactcactctcttccccccctcctgcccactctccaaagcggcgcaagcatctagcaaagctgcgcagcgcagccagcaagcttggtctggagagacagatatagccagccagagagcagcagacgaggcatggcgacgtccgtggcttgcgccttcttcttcgacgcggagccgctgggcgagcccgggcggcacgcgctggacgcctgcgcgctctgcgccaagccgctgagccgcaacagcgacatcttcatgtacaagggcgacaccccgttctgcagcgaggactgccgctacgagcagatgcaccacgacgcggcgtacgcaaggcaggcggccagcagccggcggaagcagcagcagtcgcagtcgcagcggagcagaggggcctcgtccgtgggcgccaaggcggacgtgtccgtggccagctagtcagtagtaaaagcaagcacagcgaccccaanaaaggaggaggaggaggaggaaaagaagaaggccgtgctggttgaagcagcgttcagctgcaaacctcntgggggggggggggggggccctccgctccgctcctggctgggcggg

SEQ ID NO: 37917 - protein, 100 aa, Zea mays; identical to SEQ ID NO: 16608
  misc_feature: Ceres CLONE 1424915-F
  misc_feature (14)..(66): Pfam Name: DUF581 Pfam Description: Protein of unknown function (DUF581)

SEQ ID NO: 37918 - DNA, 536 bp, Zea mays
  misc_feature: Ceres CLONE 1424922-F
  misc_feature (412)..(412): n is a, c, t, g, unknown, or other
  misc_feature (434)..(434): n is a, c, t, g, unknown, or other
  misc_feature (435)..(435): n is a, c, t, g, unknown, or other
  misc_feature (479)..(479): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (498)..(498): n is a, c, t, g, unknown, or other
ctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatgggggaagggtagtgtgggttgcatcatgggtgggggcgttccctccctggctcccgccggcggtggcttgcttgggttcctaaaaaaaccccccccgggccccgggggggccgaaaaaaaaaaaaatggtcctcaaaaggggggcccccccccaggggggaaaacccccgcgggggggggagcaaaaaaacaagggggntggcggaggggtgggaagaaannaaaaaaaaaaaaccccccccccccccggagagggggtattgttnannnntggggtggcccccnagaaacccccccccaattattttttcggggggggggga

SEQ ID NO: 37919 - DNA, 578 bp, Zea mays
  misc_feature: Ceres CLONE 1424926-F
  misc_feature (221)..(221): n is a, c, t, g, unknown, or other
  misc_feature (525)..(525): n is a, c, t, g, unknown, or other
  misc_feature (526)..(526): n is a, c, t, g, unknown, or other
aagctggagctccccgcggtggcggccgctctagaactagtggatcccccgggctgcaggattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgtcatcaagctnattagctccctctactctgatcagctagtactagcagcctacgaaggcgtggcagaatcagagagagaagcagggggctagctagctgagtcgtgcgacgaagaatgcccgaattggccagacatggtgccccccctcctgtggccaaaccccatcatggaaaattaaccggacattggggtttcccgaggtgggaaccttaaaacccttttttcaaaggggggaaacaacattcccccccggggtggggggaaaaagggccccaaattttttatttccccgggggggggtccccccccccccnncccccccctgtgtgggggcccccccccccccccaacaattgggggggggggg

SEQ ID NO: 37920 - DNA, 620 bp, Zea mays
  misc_feature: Ceres CLONE 1424930-F
  misc_feature: Encodes the peptide sequence at SEQ ID NO. 37921
  misc_feature (436)..(436): n is a, c, t, g, unknown, or other
  misc_feature (456)..(456): n is a, c, t, g, unknown, or other
  misc_feature (480)..(480): n is a, c, t, g, unknown, or other
  misc_feature (481)..(481): n is a, c, t, g, unknown, or other
  misc_feature (494)..(494): n is a, c, t, g, unknown, or other
ctggagctccccgcggtggcggccgctctagaactagtggatcccccgggctgcaggaattcgcacgagaccattacctagaacatcctaatcgaaaagttatcccccacccggacaatcttccttcaggcttcagctgtccgcccgcggcccacccctccgccgtctccaccattccgccgttcccaccacgccactcgccagttcggcactccctcctgtctcccccccttgccgagacggcgcggacgccccgtcgcccaccccgatggctgccactctcctccacgccgccaccgcctcgctccagagctcctcccagcccgcacgcgcgggcgccgccaccgcctttcaccccctcgcgtccaccccatccatacgcctcgcgcgctcctcgttctcgtccaatcgccgcctcgaggtttcactccgggcngttttcggcggtcactgttncgcggggaagggaagcacccgggnngcgcgcgtcgtcnccgccctagcaggggagcaaactgagggttcaaaaggtgggcaatgacaaggataacgccaccaggaaattagccccaaagaggtccgaagctttgaaggtaatgctggaaaattcagggtgaggc

SEQ ID NO: 37921 - protein, 90 aa, Zea mays
  misc_feature: Ceres CLONE 1424930-F
  misc_feature (63)..(63): Xaa is any aa, unknown, or other
  misc_feature (71)..(71): Xaa is any aa, unknown, or other
  misc_feature (76)..(76): Xaa is any aa, unknown, or other
MAATLLHAATASLQSSSQPARAGAATAFHPLASTPSIRLARSSFSSNRRLEVSLRAVFGGHCXAGKGSTRXARVVXALAGEQTEGSKGGQ

SEQ ID NO: 37922 - DNA, 646 bp, Zea mays
  misc_feature: Ceres CLONE 1424931-F
  misc_feature: Encodes the peptide sequence at SEQ ID NO. 37923
aaagctggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgccacctgcttaccacttggatcctggctccggagcgggcagcagaagctggattgtgaacttagagggaggtgcgtggtgcaacagcgccaagacatgcccgctcaccaggagctcccgccgtggctcgtcggaccacatggacaaagagatccccttcaccggcatcatgagcagcagccgtaccgtgaatcctggtctcgcccgattctaatttctacatctgga

SEQ ID NO: 37923 - protein, 146 aa, Zea mays
  misc_feature: Ceres CLONE 1424931-F
  misc_feature (41)..(147): Pfam Name: PAE Pfam Description: Pectinacetylesterase
MADRPSLPALIIAIAVLAGSYCRVASSASPAVEDELRGGGGAGGPTTMRRRAASVMVPITILKSAVSDGAVCMDGTPPAYHLDPGSGAGSRSWIVNLEGGAWCNSAKTCPLTRSSRRGSSDHMDKEIPFTGIMSSSRTVNPGLARF

SEQ ID NO: 37924 - DNA, 667 bp, Zea mays
  misc_feature: Ceres CLONE 1424941-F
aagctggagctccccgcggtggcggccgctctagaactagtggatcccccgggctgcaggaattcgcacgagaccattacctagaacatcctaatcgaaaactagcttctgaactaactaaaacccgcgatctgactcgactattctaaggcggcggcggcggcgatggttacctacctgcatacggataagaataagaccccggtggcgctgatgcccatcgcgtagcctctcgctgagaagaagctctgtaagcggaccctcaagctcgtgcgaagagcctctgaggccaagtgccttgagcgctgagtctaagaggtagctcagagcattctccgccggaacaaagggctgcttgtgatttgtgcaaaaatttctcctattgatgtgaatacaactgtttccatactatgtgcggaatctcaaggtccctgcctaaatggttcatctcaagacgatcttgcgacccggggaaaacacttaaagagcccattgttgcgcgctgggtctgaacacagcatacccagggggacatctttggaccagaggccaagataaactctactccccactctgaccccctttgtacgggagggttggggaagactcttcctctcagggggttgggggcccgttgccggggccctttccccttggggaatctcgc

SEQ ID NO: 37925 - DNA, 668 bp, Zea mays
  misc_feature: Ceres CLONE 1424942-F
  misc_feature: Encodes the peptide sequence at SEQ ID NO. 37926
  misc_feature (331)..(331): n is a, c, t, g, unknown, or other
  misc_feature (358)..(358): n is a, c, t, g, unknown, or other
ctggagctccccgcggtggcggccgctctagaactagtggatcccccgggctgcaggaattcgcacgagaccattacctagaacatcctaatcgaaaattaactactccgtcactttgtttgcagagctcctcctcgatccatctatgactgcaccggtcgggtgtaccgagctcgcaagggctaggcaacaagacggcagcaatagagcaccgtgacagcatcggcaacaactgcagagactacgcgacctacgggcagcagcactagcaggcaggaggcccgcgctccatgagtgagcacgtgaacgcgcatgctcaacgacaagatgncgatcgcgtgccacgcgctgagggtcncgactctcgtcacgctgggcgagcagcagctcgtgctgatggtgctggcactcaccgcctacatggtgtgatgaccgtggcaccccgtgtatccgatttcagccccgtgctcgtcctccgcacctgctcatcagagaggacgtcaagggtttcctcaactccggccccccgggggaaaggggcctttccctcgaaaaagttcctcccaaactggggaagaagggtttcccattcccccccgaaaaaatggaagaaggtcccccaccttggggggaaacccctttccccccccgggaaaataaacaaaaaa

SEQ ID NO: 37926 - protein, 33 aa, Zea mays
  misc_feature: Ceres CLONE 1424942-F
  misc_feature (2)..(2): Xaa is any aa, unknown, or other
  misc_feature (11)..(11): Xaa is any aa, unknown, or other
MXIACHALRVXTLVTLGEQQLVLMVLALTAYMV

SEQ ID NO: 37927 - DNA, 648 bp, Zea mays
  misc_feature: Ceres CLONE 1424945-F
  misc_feature: Encodes the peptide sequence at SEQ ID NO. 37928
aaagctggagctccccgcggtggcggccgctctagaactagtggatcccccgggctgcaggaattcgcacgagaccattacctagaacatcctaatcgaaaaatcccatcccctcaggcctcagtcgtcagtccctcacacactcactatacactgctctgctgcaccaagaaggaagaagctagcgcctccctagctctcgttgtcagcaatggccaccaccgccgcgtccagcctcctcaagtcctccttcgcgggctcccggctcccttcagccacgcgcaccaccaccccgtcgtccgtggacgtggccaccccgcgcgccggcggcggccccatccgcgagtccatctcctcctcccccaccccgccgtacgacctgacgtccttccggttcagccccatcaaggagtccatcgagtcccgcgagatgacccggcgctacatgacggatatgatcacccacgccgacaccgacgtggtgatcgtgggcgccgggtccgcgggcctgtcctgcgcgtacgagctgtccaaggacccctccgtgagcgtcgccatcgtggagcagtccgtgtccccgggcggaggcacgtgactgggcgggcagctgttctcggccatggtggtgcgcacgccggcgcacctgtt

SEQ ID NO: 37928 - protein, 127 aa, Zea mays
  misc_feature: Ceres CLONE 1424945-F
MATTAASSLLKSSFAGSRLPSATRTTTPSSVDVATPRAGGGPIRESISSSPTPPYDLTSFRFSPIKESIESREMTRRYMTDMITHADTDVVIVGAGSAGLSCAYELSKDPSVSVAIVEQSVSPGGGT

SEQ ID NO: 37929 - DNA, 485 bp, Zea mays
  misc_feature: Ceres CLONE 1424947-F
  misc_feature: Encodes the peptide sequence at SEQ ID NO. 37930
  misc_feature (251)..(251): n is a, c, t, g, unknown, or other
  misc_feature (252)..(252): n is a, c, t, g, unknown, or other
  misc_feature (261)..(261): n is a, c, t, g, unknown, or other
  misc_feature (262)..(262): n is a, c, t, g, unknown, or other
  misc_feature (266)..(266): n is a, c, t, g, unknown, or other
ctggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctgnntggtgggcnncgcngcggtgtgcaacatgaacaacgagcagttcatgtcgtggcaacccccgggggcaaaaaaaaggacccccgggccggcccttcaagggtgttttcaaacccctgtgggggggggggaaaacccaaagggggggggggggaaaaaaaaaaccccggggggagggggggtttaaaaaaaaattccccccccccccgggccccggtggaggttttctcccgcc

SEQ ID NO: 37930 - protein, 111 aa, Zea mays
  misc_feature: Ceres CLONE 1424947-F
  misc_feature (34)..(34): Xaa is any aa, unknown, or other
  misc_feature (37)..(37): Xaa is any aa, unknown, or other
  misc_feature (39)..(39): Xaa is any aa, unknown, or other
MAATSSKSSSSSSSAQRAAAALLVAAAVAVSVLXGGXRXGVQHEQRAVHVVATPGGKKKDPRAGPSRVFSNPCGGGGKPKGGGGEKKNPGGRGGLKKNSPPPRAPVEVFSR

SEQ ID NO: 37931 - DNA, 653 bp, Zea mays
  misc_feature: Ceres CLONE 1424964-F
  misc_feature: Encodes the peptide sequence at SEQ ID NO. 37932
aaagctggagctccccgcggtggcggccgctcttttccagtggatcccccgggctgcaggattccccacgagaccattacctagaacatcctaatcaaaaaaaaatctcaaaaacccaacctttactattttgtttcttccttactccaaccaaacacttctcgtctccaatggcttccttatccttcgtctcatcatctcacctcactctacgcgctccttctcccaacaacctccgctcctcatctccccgtcccacctccgtttcattctccgtcaaggcccagtccgtcgcactctcccaagacgacctaaagaaactcgccgccgaaaaagccgtcgaatccatcaaaccaggaatggtcctcggcctcggaaccggctccaccgccgccttcgccgtcgaccaaatcggaaaactcctctcctccggccaactccacgacatcgtcggcatcccgacgtcaaaacgaaccgaagaccaggccagatccctcgggatccccctcgtggccctcgacacgcaccccagaatcgacctggccatcgacggcgccgacgaggtggatcccaacctggacctggtcaaggggcgcggcggcgcgctcctgagggagaagatggtggacgccgtggccgagagatttatcgtc

SEQ ID NO: 37932 - protein, 161 aa, Zea mays
  misc_feature: Ceres CLONE 1424964-F
  misc_feature (93)..(161): Pfam Name: Rib_5-P_isom_A Pfam Description: Ribose 5-phosphate isomerase A (phosphoriboisomerase A)
  misc_feature: SWISSPROT Homolog: EC 5.3.1.6 Ribose-5-phosphate isomerase
MASLSFVSSSHLTLRAPSPNNLRSSSPRPTSVSFSVKAQSVALSQDDLKKLAAEKAVESIKPGMVLGLGTGSTAAFAVDQIGKLLSSGQLHDIVGIPTSKRTEDQARSLGIPLVALDTHPRIDLAIDGADEVDPNLDLVKGRGGALLREKMVDAVAERFIV

SEQ ID NO: 37933 - DNA, 594 bp, Zea mays
  misc_feature: Ceres CLONE 1424968-F
  misc_feature: Encodes the peptide sequence at SEQ ID NO. 37934
  misc_feature (253)..(253): n is a, c, t, g, unknown, or other
aagctggagctccccgcggtggcggccgctctagaactagtggatcccccgggctgcaggaattcgcacgagaccattacctagaacatcctaatcgaaaaaaaaccctccatccattctacacgcgccgccgcactcctgtacacgccccgccgccaccgcctccaccaccacagcgcgcaggaatccctcgttctctgagggtttcaggcgtcgtatgtaagaagagatggcgctctcagtatccatgganggcatccaagcgcgggcgcgggatctccgggtggacctctccgctgtcgatctggaactcatcaaccctcccgggcgggcgaggacttcggcatccgtcagggatgaccaggaagtacctccgtggggaggatctttcccaaaactgaaatggggtttgtgcaacattattgtgcgcgggacaaacctggcaatttgttcccccccaaaaattttggaaaacttggaaatgtgctaccccaaatcttcccgccaaatttgggaccgataaaaggaaatgggcccatggagtgcccggtaaaccccaaaaacaaaaaaaacattcgggttactggtttcctg

SEQ ID NO: 37934 - protein, 97 aa, Zea mays
  misc_feature: Ceres CLONE 1424968-F
  misc_feature (8)..(8): Xaa is any aa, unknown, or other
MALSVSMXGIQARARDLRVDLSAVDLELINPPGRARTSASVRDDQEVPPWGGSFPKLKWGLCNIIVRGTNLAICSPPKILENLEMCYPKSSRQIWDR

SEQ ID NO: 37935 - DNA, 635 bp, Zea mays
  misc_feature: Ceres CLONE 1424971-F
  misc_feature: Encodes the peptide sequence at SEQ ID NO. 37936
cgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatct

SEQ ID NO: 37936 - protein, 35 aa, Zea mays; identical to SEQ ID NO: 36216
  misc_feature: Ceres CLONE 1424971-F

SEQ ID NO: 37937 - DNA, 659 bp, Zea mays
  misc_feature: Ceres CLONE 1424973-F
  misc_feature: Encodes the peptide sequence at SEQ ID NO. 37938
aaagctggagctccccgcggtggcggccgctctagaactagtggatcccccgggctgcaggaattcgcacgagaccattacctagaacatcctaatcgaaaaattagttcggtgcctttttctagcggggaggaggcaggaggatcaatctggcaccggccatctcgttccctcccgccgcttccccctcggtgacctcccgttccccagatctgaaggcattcaaacctgcggatctcacctgcagggtcgtcgtccgcggcatctgggctagccagtggtaaagccatcctgcatgagatggcatagcatcggcatcctcctgatggcgctggtcctcagtgcggcagcgtctgcaggaacgcgcccgtggccccagatcctgtgtgggcaccaggcccatgatactcgtgactcctcggtacagagacgggtggagcctattccgggcagacgccggaacgatgatgctggactcctctgactgtgcctctgctgacgcctccgcgaaggcggaggaggtgcatcctacgacccacgctgtggctggcgtagccctagcgcacaacacgtgctactccatctgcttatgggagagagtatatcgctgactgacctgtggatactcgagttttagacgcaatagattctacgatggg

SEQ ID NO: 37938 - protein, 69 aa, Zea mays
  misc_feature: Ceres CLONE 1424973-F
MILVTPRYRDGWSLFRADAGTMMLDSSDCASADASAKAEEVHPTTHAVAGVALAHNTCYSICLWERVYR

SEQ ID NO: 37939 - DNA, 654 bp, Zea mays
  misc_feature: Ceres CLONE 1424974-F
  misc_feature (283)..(283): n is a, c, t, g, unknown, or other
  misc_feature (292)..(292): n is a, c, t, g, unknown, or other
  misc_feature (357)..(357): n is a, c, t, g, unknown, or other
  misc_feature (441)..(441): n is a, c, t, g, unknown, or other
ggagctccccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaaaggcgtggncagaatcangagagagatagcaggggggctagctagctgaactcgtgcgacgaagaaatggcggaaatgggcangaacaatggtgggcccggctccctggtgctcaacttcatcagggacatcatcgtcatcggcttcccgagcttggaccctggacnactttcatcaaccgggaagaacaaataacccccgggtgggccgggaaaggggcgaaccttttacattccgggggttcccccaaaccgggcccggggtgggggggggcgggggccccaaacggggggggggggacccccaggggccgccctggggcccccaaaaaccttgggcaccaaaaaccgcgggggttggctaatcgcccgggggccacc

SEQ ID NO: 37940 - DNA, 934 bp, Zea mays
  misc_feature: Ceres CLONE 1424986-R
  misc_feature: SWISSPROT Homolog: EC 2.1.1.104 Caffeoyl-CoA O-methyltransferase
  misc_feature (20)..(20): n is a, c, t, g, unknown, or other
tttttttttttttttttttnaggtgggaaaatatataaaaaaataattctattatatttaataaaataaaataaaataatataattggggtccgggccccccctcgaggtcgacggtatcgataagcttttttttttttttttttggcatgatgttgcattgcattccagttgttgcagtacatcgccggatgttcaactcaacacacacagtgcaagtacaaaaaaaaaaaagaacaagaaccatgcattattaattgacgacggcagcggacagcggcgggcaggcagttgaaagatgacagagacgacgagcgaatgatatatgatcttggtcgtcggatcatcatcacatcagacgacgcggcggcagatggtgacgccgtcggcgatggcgagctggcagacctcgacgcggggatcctgagaaagccggacgttgagttccctgatggcggcggagaacctgcggtcgaggtcgctgagcggcgcgtcggggggaagcgccacagtaccggcccacagcgtgttgtcgtacacgacggtacccccgacgcgcaccaggcggagcagctgctcgtggtaccggacgtagttaggcttgtcggcgtcgacgaaggcgaagtccaaggcgccgtggttggccggggtcggcgaaagagctcgtccaagctgcttcaagcggccgggccccctccgggaaatccaaccttgccccgccacccccgggggcggctccaattaaaggggccggcccaaagttcctaagttactcgccgggctcaccgtcgaaatgcgaatgaacctttgccctccgggcgggtcaaacgcccaaaaacccgtccgccaaacaaaccaaagtaaccccccttgaaaaaaagcccaaaccttctaaaggtttccggccccgggggccccgttttaaacttttgaac

SEQ ID NO: 37941 - DNA, 649 bp, Zea mays
  misc_feature: Ceres CLONE 1424987-F
  misc_feature: SWISSPROT Homolog: EC 4.1.2.13 Fructose-bisphosphate aldolase
ctggagctccccgcggtggcggccgctctagaactagtggatcccccgggctgcaggaattcgcacgagaccattacctagaacatcctaatcgaaaactgccttaaccgttcctcccagcaccacctcgcctgcgatcttcttagcctccgtcgcgtcgagcatccatcatgtctgcctactgcggaaagtacacaggatgacctcatcaacaatgctgcctacattggcacccccggcaagggtatccttgctgctgatgactccgctggtcccattggcaatcgcctttccagcatcaatgtcaagaacgttgaagagaaccgccttgccctccgtgagctcctattctgctgccctgttgctctccagtacaccatcggcgtgatcctcttcgaggagaccctgtaccacaggactgacgatggcacgccttttattgatgtcctcgatgagcggaggcgtcctccctgtcatctacgttgacaagggcaccagtgacgttgctagcactgattaggagacaaccacccatagccatgacgaccttgccaagcgttgcaccgagtactacgatgcacgcgctcgctctagccagtgctgcgctgttctcagattgcacctactgatccatctcagcttgccatca

SEQ ID NO: 37942 - DNA, 638 bp, Zea mays
  misc_feature: Ceres CLONE 1425003-F
aaagctggagctccccgcggtggcggccgctctagaactagtggatcccccgggctgcaggaattcgcacgagaccattacctagaacatcctaatcgaaaaacccaaagttctaagtttgattgtgcaaattgcaccggcacatcaatgttcgaagactgctccttcatcctctcacgtgatcagggctctctccaattaatactacatcaatatgaaaagggggtacggttacagtcattcaccatgcgacgggctgcaggacaaaggtccgcaccccacatcctcatgatcattaaggcggacctgttacggatctcccaagcagtcttctggtagagaatctcctacgggactacacggcagatgatcttcgtcaaccttttgtacagtttgctcgacttaaagatatatatctacttcgagattaatatgctgttcagcccctagggcttggctttgctccataatatcatccagctgatgctgctgatgctcatcaaatatggatggtcaggcacatcttggcaagaaataaccatgttgttgaagacataacacacgcacgcctcatcagatgagagatagctacagactcacggctcatgcttatcatgacatgaggcattctacgtcta

SEQ ID NO: 37943 - DNA, 664 bp, Zea mays
  misc_feature: Ceres CLONE 1425010-F
  misc_feature: Encodes the peptide sequence at SEQ ID NO. 37944
ggagctccccgcggtggcggccgctctagaactagtggatcccccgggctgcaggaattcgcacgagaccattacctagaacatcctaatcgaaaacttatcgttatggcttccgtcgctttgccggcgttcacctgccggagctcagcagatccgacgaaggaacttcgcgtctgcacgaaccgcacctgccgaaaacaaggctcattccaaatcctcgagacgctaacgtccctcgcacctccccaactccaagtcaatccctgcggctgcctcggccgatgcggctcgggtccgaacctcgtcgctctccctcaaggtctcttccttcgtcactgcgccacgccttctcgagctgctgaaatcttgttcagcctatgcggcgacggcagggaagcttcctcttcctccgccgtcgcagaggctctcgccgctttggcgctaaccaacaatgctctctctcagatcgaagctgagaacttcgaagaagcagagtcgcttctcacacaggctttagagatgaaaccatacggtggactgcatagaatcttcaaacacagagcagtggcgaaactaggaatggttgattactctggggctcttgaagatataagccaagctctagcattaggtcctaactattatgagccctacgtttgccaag

SEQ ID NO: 37944 - protein, 186 aa, Zea mays
  misc_feature: Ceres CLONE 1425010-F
MASVALPAFTCRSSADPTKELRVCTNRTCRKQGSFQILETLTSLAPPQLQVNPCGCLGRCGSGPNLVALPQGLFLRHCATPSRAAEILFSLCGDGREASSSSAVAEALAALALTNNALSQIEAENFEEAESLLTQALEMKPYGGLHRIFKHRAVAKLGMVDYSGALEDISQALALGPNYYEPYVCQ

SEQ ID NO: 37945 - DNA, 653 bp, Zea mays
  misc_feature: Ceres CLONE 1425031-F
  misc_feature: Encodes the peptide sequence at SEQ ID NO. 37946
aagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggaccgagtggtcgaacgggaccgctaggaggacctgcggtggtgcaagcacgcgtgcgagtggcaatacggacacgacaccccgcggaatagggaatgccagagcgagtgccgcgagcggcaccagcaagctgacgcgagcgaggacggctacagcggcgtggacgcctacgtctcccgctcctggaagggcgagtgccggcaccagtgcctgcgccgccacaagggccagtcgtgcgaagaccaggagtgcatgaggaggtgcctccgccgcggactggccgtcaacatgaagcaagagtacagtcgcggcaacgagagcgctggcaagtgcctcgagaagtgcgagcgcc

SEQ ID NO: 37946 - protein, 38 aa, Zea mays
  misc_feature: Ceres CLONE 1425031-F
MGKGSVGASWWAFLLLAGVLLVVAATAGAEDRVVERDR

SEQ ID NO: 37947 - DNA, 661 bp, Zea mays
  misc_feature: Ceres CLONE 1425034-F
  misc_feature: Encodes the peptide sequence at SEQ ID NO. 37948
ctggagctccccgcggtggcggccgctctagaactagtggatcccccgggctgcaggaattcgcacgagaccattacctagaacatcctaatcgaaaagttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctc

SEQ ID NO: 37948 - protein, 139 aa, Zea mays
  misc_feature: Ceres CLONE 1425034-F
  misc_feature (58)..(139): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEI

SEQ ID NO: 37949 - DNA, 572 bp, Zea mays
  misc_feature: Ceres CLONE 1425035-F
  misc_feature: Encodes the peptide sequence at SEQ ID NO. 37950
  misc_feature (240)..(240): n is a, c, t, g, unknown, or other
  misc_feature (300)..(300): n is a, c, t, g, unknown, or other
gctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtacccacccggggcgccctcaaggcnggcgttccctgagttcatcttcacccctcattttcgtcttccccgggcaggggttcgggntggccttttaaaaagtaaaccggggggggcccaaaaaccccggggggcttaaaccggggggggggggcgccccctttccccctttttttgggggttttttggggggaaaaaattccgggggggaaaaaaacccccggggggacttttgcggccctttgggggggggaaaacccccctttttggggggcctcttttatgggggggggggccccttggggggggcccccccgggggggggccccccccccccccccccccggaggggggggggg

SEQ ID NO: 37950 - protein, 59 aa, Zea mays
  misc_feature: Ceres CLONE 1425035-F
  misc_feature (23)..(23): Xaa is any aa, unknown, or other
  misc_feature (43)..(43): Xaa is any aa, unknown, or other
MPINRIALGSHQEVYPPGAPSRXAFPEFIFTPHFRLPRAGVRXGLLKSKPGGAQKPRGA

SEQ ID NO: 37951 - DNA, 616 bp, Zea mays
  misc_feature: Ceres CLONE 1425050-F
  misc_feature: Encodes the peptide sequence at SEQ ID NO. 37952
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (65)..(65): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (85)..(85): n is a, c, t, g, unknown, or other
  misc_feature (86)..(86): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (429)..(429): n is a, c, t, g, unknown, or other
  misc_feature (467)..(467): n is a, c, t, g, unknown, or other
  misc_feature (478)..(478): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
nggggnnnnnnnnnnnggggggggggggggggggggggggnnnggggnggggggggnnnnggggngaaccnnnnncnnnnnnggnngggnnnnngnnnnnnnnnnnnnnnnnnccaaactgggactccaccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacngcgctcaaggccgcgacggccgcgacccttcggcgggntcgatgctggntgctgtcccgggctgaatctgggcgggcacccgtgatcgccgctcacgggtgcccacccccggtggctggtgatcttcagcgggnntnggggggggccgcggcccccccattcgggctggggggcctcaagggggggg

SEQ ID NO: 37952 - protein, 101 aa, Zea mays
  misc_feature: Ceres CLONE 1425050-F
  misc_feature (52)..(52): Xaa is any aa, unknown, or other
  misc_feature (56)..(56): Xaa is any aa, unknown, or other
  misc_feature (84)..(84): Xaa is any aa, unknown, or other
  misc_feature (85)..(85): Xaa is any aa, unknown, or other
MADHHRGATGGGGGYGDLQRGGGMHGEAQQQQKQGAMMTALKAATAATLRRXRCWXLSRAESGRAPVIAAHGCPPPVAGDLQRXXGGAAAPPFGLGGLKGG

SEQ ID NO: 37953 - DNA, 639 bp, Zea mays
  misc_feature: Ceres CLONE 1425061-F
  misc_feature: Encodes the peptide sequence at SEQ ID NO. 37954
aaagctggagctccccgcggtggcggccgctctagaactagtggatcccccgggctgcaggaattcgcacgagaccattacctagaacatcctaatcgaaaaaacaattccggcaatttgtgttgtaaagctcctcctcgatagcatcgtatcactgcaccggctggcggcaccgcgctcgcatgggctatccagcgatacggcaatcctgtcggatcgtgacaccaaagggatctactgcagcgccctccccacctaccggcatcgtctccaacacggaggaggctggcgcccgatgtgcgagcatgtgaatggcatgctccacgacgaggcaccgacggagtatcatgcgctgacgggaggtaactactcacactcggcggtctgcagctagtgctgtcagggcatgctctgacaggctccgtggtggggctaggcgaggccaccccggtgttacagatgttcacccgcagttactacccgccgatctgctcagtagagatgtcgtcatgggatactaggactggcgcgctggggctggggggattgtccctctgtaagtgacttgctgatcggtgcgtggagcgatcaaacggcccctgactactggacgaggctcaacgctgctggggatgccgc

SEQ ID NO: 37954 - protein, 32 aa, Zea mays
  misc_feature: Ceres CLONE 1425061-F
MCEHVNGMLHDEAPTEYHALTGGNYSHSAVCS

SEQ ID NO: 37955 - DNA, 661 bp, Zea mays
  misc_feature: Ceres CLONE 1425075-F
  misc_feature: Encodes the peptide sequence at SEQ ID NO. 37956
  misc_feature (511)..(511): n is a, c, t, g, unknown, or other
agagctggagctccccgcggtggcggccgctctagaactagtggatcccccgggctgcaggaattcgcacgagaccattacctagaacatcctaatcggaaagaacgcccagtcctagtctgatctaatgggaatgtacggaatctcgtctcccatctcgcacttgagttgagactactgttgtgactattgtgtgcgtgagagagaaacagaagaggaaaaggaatccatggcggcgacgctggcgaggagggcggggcgctccgcggcgacgacgctatggggcgcggcgaggggcttcgcatcggtggggtccgacatcgtctctgcggctcccggcgtgtcgctgcagaaggcgcggtcctgggacgagggcgtcgccaccaagttctctaccacgcctctcaaggacatcttctacgggaagaaggtggtcatcttcggcttgcccggtgcatatacaggggttttgtcacaagcgcacgttcctagttacaagaagaatattgancagttgaaagcaaaaggaatcgactctgttatctgtgtagctgtgaatgatccgtatgtcctggatggatgggcaaaaaagctagacgctaaagaaccattggagttctatggggacttttgatgggaggttccacaaaaagcttggatt

SEQ ID NO: 37956 - protein, 134 aa, Zea mays
  misc_feature: Ceres CLONE 1425075-F
  misc_feature: SWISSPROT Homolog: EC 1.11.1.15 Peroxiredoxin
  misc_feature (94)..(94): Xaa is any aa, unknown, or other
MAATLARRAGRSAATTLWGAARGFASVGSDIVSAAPGVSLQKARSWDEGVATKFSTTPLKDIFYGKKVVIFGLPGAYTGVLSQAHVPSYKKNIXQLKAKGIDSVICVAVNDPYVLDGWAKKLDAKEPLEFYGDF

SEQ ID NO: 37957 - DNA, 672 bp, Zea mays
  misc_feature: Ceres CLONE 1425085-F
  misc_feature: Encodes the peptide sequence at SEQ ID NO. 37958
aagctggagctccccgcggtggcggccgctctagaactagtggatcccccgggctgcaggaattcgcacgagaccattacctagaacatcctaatcgaaaagcaacgattacggtaacgccgtcgccgccctacggctcagatcttcgtcgtcatcttctccggcaacgagcacccaaggatggtggtccttcaaccagatcggttcctgagcgagctgacgagcatgtacgagcggagcacgtagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagttccaagcttcatacgcaacagttcttaaggcccatatgcatgctctgaagaaaagggagaggaaagacaagaagaaggctgcagatgctgagaaggcaattgagaccgcacccaagaagcagaagaaagcatcttcaaagaaatcttcggggtccaagtcataaggcgctcgcagaaatcagtgtcttctcccttctgttgttaccgcaccgccagactaattagagtgtcgtgaattttatctggtttttatccgaatg

SEQ ID NO: 37958 - protein, 102 aa, Zea mays
  misc_feature: Ceres CLONE 1425085-F
  misc_feature (1)..(64): Pfam Name: SRP14 Pfam Description: Signal recognition particle 14kD protein
MKRSTLKGKAQLRKMENKGQEVEHRCLVRASNGKKNISTSVSLKEYTKFQASYATVLKAHMHALKKRERKDKKKAADAEKAIETAPKKQKKASSKKSSGSKS

SEQ ID NO: 37959 - DNA, 648 bp, Zea mays
  misc_feature: Ceres CLONE 1425088-F
  misc_feature (422)..(422): n is a, c, t, g, unknown, or other
aagctggagctccccgcggtggcggccgctctagaactagtggatcccccgggctgcaggaattcgcacgagaccattacctagaacatcctaatcgaaaaattccgacgccgtcttcaccatcttctgcttgctctggggggaaggatagagacagagcgagagagagatctagtagagaggctagctaggtggtcctctaacgaagatgatggcggtgttcagcgggtcacgtggtggaggtgccagcagagctggtggcggcgggcaaccggacgccgtcacccaaaacgaaagcgtcacagctggtggggcgcttcctggccgcctccgagccggccgtgtccgtgcagctcggctaccacagacacctcgcctactcccacaacaacgaagcgctcctccggcacatgtcgtacgcnggcaaggactaggtgttctgcctgttccaggcggtgctgagacacctgagccgtctgagcctgctccacgggctgccaagcgagggcgccaacgaggtgctcctcttcatcgatggctagaagacgatgcgcgaccactcgccctagccggtcagcttcttgatcgcccaggtcaccagctcctaggccttcgtcctcttctacgagtccaccaactccctgatag

SEQ ID NO: 37960 - DNA, 642 bp, Zea mays
  misc_feature: Ceres CLONE 1425090-F
aaactggagctccccgcggtggcggccgctctagaactagtggatcccccgggctgcaggaattcgcacgagaccattacctagaacatcctaatcgaaaaacattcgaagagagaggacacacctcaaagctaaagagcgaaaatggcagcagacgactctctccaggataagcctgatcctttcctcatcatcacccatgtctcgccggcggtgccatcccttcttcacccgactcgacggcggtcgaattcccatctcggtacgtgtcttactgccacctcctccacactaacccaccgcgccagcgacgtccgccccctcgccggcgtcaaatccccggagaaaatcgagaaaatcggatgcgagatctcctccctcaccctcaaaaaatcccggatcctcatcgactacctccagaacaagttaggcgtcacgcctctctccttggctcccgccgcaacgactgtcgctgctccgtgatacggcggcagcgcgccggccgtagcgcaagaacacacagaattcgatgtggtgattaacgaggtgccaatcatctcgcgtatcgcggtgattaaagcagcgagagcgttaactatctcggcgttgaacgaagcaaaggagcttatcgaaggcctgcca

SEQ ID NO: 37961 - DNA, 700 bp, Zea mays
  misc_feature: Ceres CLONE 1425106-F
  misc_feature: Encodes the peptide sequence at SEQ ID NO. 37962
  misc_feature (361)..(361): n is a, c, t, g, unknown, or other
  misc_feature (419)..(419): n is a, c, t, g, unknown, or other
  misc_feature (421)..(421): n is a, c, t, g, unknown, or other
aaagctggagctccccgcggtggcggccgctctagaactagtggatcccccgggctgcaggaattcgcacgagaccattacctagaacatcctaatcgaaaacccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaagaggagcccgtatccctccgccccgctgcccgccggaacgatggactccgagcactggatctcgcgcctgggncgcgcgaagcgcttctacgcggctcagctcggccacagcgatcgggccgggatggacnanctggaaagaacaaagaggtcaggcccgagttcccctgccctactggtacgaggaccacgaagtcggatcctttgggcgcggcccgggaggaaggaacaccggttgaaccccaaccccggggcctggccctgtttggtcaaaaatgggttaccaaaggaatgggttaaacctttttcccgcccccagtgggatttttttttcaaaaatcccccccgggggggggaaaaatttactttttcgggggggccgggggccccttttttgggggaaggaaaagaa

SEQ ID NO: 37962 - protein, 124 aa, Zea mays
  misc_feature: Ceres CLONE 1425106-F
  misc_feature (31)..(31): Xaa is any aa, unknown, or other
MDSEHWISRLGRAKRFYAAQLGHSDRAGMDXLERTKRSGPSSPALLVRGPRSRILWARPGRKEHRLNPNPGAWPCLVKNGLPKEWVKPFSRPQWDFFFKNPPRGGEKFTFSGGPGAPFLGEGKE

SEQ ID NO: 37963 - DNA, 635 bp, Zea mays
  misc_feature: Ceres CLONE 1425107-F
  misc_feature: Encodes the peptide sequence at SEQ ID NO. 37964
aagctggagctcaccgcggtggcggccgctctagaactagtggatcccccgggctgcaggaattcgcacgagaccattacctagaacatcctaatcgaaaaaatgccatgcgcgcgctactgcatctgcggctcatcaatccgtgcagtcccagagcaccccgtcttcccgctactcccgcaagggcgctcgtcgcttccttctccgggacgtggcaggcaccttctggtagagcgagagcgagagcagcgccgccggcagttcacgctatggcgtcccagcaggtgttccgggctcagcagcagcagcagcatcagttcccggctcagcagcaggagtcccagccggggaaggagcacgcgatggacccccggcccgaggccatcgtccaggactacaaggccgccaacaagctcaaggacaaggtggcgctcgtgaccggcggcgactccggcatcgggcgcgccgtgtgcctgtgcttcgcgaaggagggcgcgacggtggccttcaccttcgtgagggggcaggaggagaaggacgcggaggagacgctgcgtgcgctgcgcgacatcaggtccgagacgggcgcgcgcgagccgatggccctgcccgccgacctcgggtacgaggccaac

SEQ ID NO: 37964 - protein, 122 aa, Zea mays
  misc_feature: Ceres CLONE 1425107-F
  misc_feature (49)..(93): SWISSPROT Homolog: EC 1.1.1.47 Glucose 1-dehydrogenase
  misc_feature (48)..(79): SWISSPROT Homolog: EC 1.3.1.56 Cis-2,3-dihydrobiphenyl-2,3-diol dehydrogenase
  misc_feature: The sequence is a functional homolog of SEQ ID NO 2 in US patent 7189890
MASQQVFRAQQQQQHQFPAQQQESQPGKEHAMDPRPEAIVQDYKAANKLKDKVALVTGGDSGIGRAVCLCFAKEGATVAFTFVRGQEEKDAEETLRALRDIRSETGAREPMALPADLGYEAN

SEQ ID NO: 37965 - DNA, 652 bp, Zea mays
  misc_feature: Ceres CLONE 1425118-F
  misc_feature: Encodes the peptide sequence at SEQ ID NO. 37966
  misc_feature (642)..(642): n is a, c, t, g, unknown, or other
aagctggagctccccgcggtggcggccgctctagaactagtggatcccccgggctgcaggaattcgcacgagaccattacctagaacatcctaatcgaaaaatctatcactctattattcttatttcaatcatcagccgtaggagctctggtcagcgtgctgcaagtgcgggacgctagatcgctatgctagcctaccatggatgataaccaacggggtgccaccggaaatgccaagagttacggcgacctccacagcgggggcggcatgaacagcaagtcgcagcaaaagcacatgcagggcgccatgatgactgcgctcagtgccataacggcctcgatctacagcgggtcgatcctggtgctgtctggactgatcctgccgtgcacctgatcgcgctcatcgaggcctccccgtgatgtgatcatcatgccgagaggtgccgacgacatcagaatagcccttatgcggcagggatgtgcacctctgggtgccctcgcatcacagctctgaccatgttttgctgggatgtaccaattcctgaagggggagaccctcgccgggttgcccaccagtttggcctcccccaaaagcaaagcttggcaaagcaagggcccacaaaaatccaaaggatgcctcaanaacggccgga

SEQ ID NO: 37966 - protein, 64 aa, Zea mays
  misc_feature: Ceres CLONE 1425118-F
MDDNQRGATGNAKSYGDLHSGGGMNSKSQQKHMQGAMMTALSAITASIYSGSILVLSGLILPCT

SEQ ID NO: 37967 - DNA, 686 bp, Zea mays
  misc_feature: Ceres CLONE 1425119-F
  misc_feature: Translation starting site: 244
  misc_feature (1)..(1): n is a, c, t, g, unknown, or other
  misc_feature (311)..(311): n is a, c, t, g, unknown, or other
  misc_feature (331)..(331): n is a, c, t, g, unknown, or other
  misc_feature (337)..(337): n is a, c, t, g, unknown, or other
  misc_feature (343)..(343): n is a, c, t, g, unknown, or other
  misc_feature (347)..(347): n is a, c, t, g, unknown, or other
  misc_feature (350)..(350): n is a, c, t, g, unknown, or other
  misc_feature (365)..(365): n is a, c, t, g, unknown, or other
naaagctggagctccccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgcaatcacacgcgcgccacccgcgatgacgccggcggcggcgatctccggctccagcagccacgtcgtcgtctcctccgcccgcctcaggcnagccgtcacgctccctcggngcacgntttgcnaatnggncggcggcgctcgccngtgaccccgcgcggggtcgcggtcccccccgggtcaacccccgtttggtcccccgcccgggggaggaatccaaacaggcccccaaggattccctcaaatcttggttttgcacgggaaacaaaatgaaaattcttaaccccccctcggggttagggtttaaaaaattgggaaaaaaaatctcccaccttttaaaggaaaaaaagggccctttatttttcccacccccctaaggagaaccgtgtgtttttttaaagagggatttttttttttgggggggggggtttttttttttggggccaaaaataaacccgtgggggggaa

SEQ ID NO: 37968 - DNA, 672 bp, Zea mays
  misc_feature: Ceres CLONE 1425120-F
  misc_feature: Encodes the peptide sequence at SEQ ID NO. 37969
aaagctggagctccccgcggtggcggccgctctagaactagtggatcccccgggctgcaggaattcgcacgagaccattacctagaacatcctaatcgaaaaaggattttgtttcgggtgaggtggggggcggcatggcgccacccgccgctcaggctcagctcctcctctccaaccacccctcgccgttgctgtcgccgccgcaacgtcgtcgcctcctcggtggaccgccgcctcgctcacacacctgcgccatccggcaccaccacggccacgacaagtgcgcctcctcctcctccactcgccttcgccacgccctccgcccgcccgccgccaccgccgtggccatcgcgcccggcgaccactggggaaactgggccttcctcctctccgccgccgcgttcggcacatgggcggaagaagaaacgtcgtgtggcgccgcgctcaacggcgcgctggttacatcatggccggcctggctgccaaggccgtcggccttctcacccccggggggcccccgcacaaacccgtcatggaagaacctgctgccgggcgccgttcccgctttttaatcctcgggggcgaaacttcggcctggtcttccgcaaccacccggggaccttcctcaaagggatccccggccccggaatctggttgccaactgtaaatccg

SEQ ID NO: 37969 - protein, 145 aa, Zea mays
  misc_feature: Ceres CLONE 1425120-F
MAPPAAQAQLLLSNHPSPLLSPPQRRRLLGGPPPRSHTCAIRHHHGHDKCASSSSTRLRHALRPPAATAVAIAPGDHWGNWAFLLSAAAFGTWAEEETSCGAALNGALVTSWPAWLPRPSAFSPPGGPRTNPSWKNLLPGAVPAF

SEQ ID NO: 37970 - DNA, 742 bp, Zea mays
  misc_feature: Ceres CLONE 1425121-F
  misc_feature: Encodes the peptide sequence at SEQ ID NO. 37971
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (630)..(630): n is a, c, t, g, unknown, or other
  misc_feature (739)..(739): n is a, c, t, g, unknown, or other
ctggagctccccgcggtggcggccgctctagaactagtggatcccccgggctgcaggaattcgcacgagaccattacctagaacatcctaatcgaaaatcccacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggcgagcaggcgggaatctccgccgtcatcccaggatggttctccgagatcagccccatgtggcccggtgaggcgcactccttgaaggtggagaaggttctgttccagggcaagtcagactaccaaaatgtgatggtttttcagtcctccacgtacgggaaggtgcttgtcctcgacggagttattcaggtgacagagagggatgagtgcgcgtaccaagagatgattactcacctgcccctttgctccatcaaagaccccaagaaggtgttgttatgagggggaaaannnnnnnnnnttttttttttnnnnnnnntttttccngggtatattttctgtggaagcatattggacatctgtgaaaattgaataagatgggtgggtagatggtctcaaagcaattttttccctccatcttagctgtttggatttngaa

SEQ ID NO: 37971 - protein, 123 aa, Zea mays
  misc_feature: Ceres CLONE 1425121-F
  misc_feature: SWISSPROT Homolog: EC 2.5.1.16 Spermidine synthase
MEAEAAAKRAREGGEDATAPVAGAEAVVAGAGEQAGISAVIPGWFSEISPMWPGEAHSLKVEKVLFQGKSDYQNVMVFQSSTYGKVLVLDGVIQVTERDECAYQEMITHLPLCSIKDPKKVLL

SEQ ID NO: 37972 - DNA, 656 bp, Zea mays
  misc_feature: Ceres CLONE 1425126-F
ggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaaggtcaccaagctctgcgatttggggcctagggacagcgtatgcgcagtgcattggtcacgggaaggctcttatctttccattggcaccggccttggagatgtccagatttgggatagtttctcgtgta

SEQ ID NO: 37973 - DNA, 657 bp, Zea mays
  misc_feature: Ceres CLONE 1425127-F
  misc_feature: Encodes the peptide sequence at SEQ ID NO. 37974
  misc_feature (509)..(509): n is a, c, t, g, unknown, or other
  misc_feature (512)..(512): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaagccgttcgctgctcggcgctctcctctcccgacgacagctacacctcacaaccgtgagctcatgaaggaacgctgttcgcaattccggcgccggcaccatgagtaagctgcagagtgattctctgagggacgcgattgcctcaattaccaatgattcccgtgagaagcagcgcaaatttgttgaaaccattgagctacgaattgcactgaagaactatgacccctcaaaggacaagcgcttcagcggttcatgtaagctgcctcacatccctcgccctaagatgaaggtttgcatgcttggtgatgctcatcatgctgaggaggcagagacaatgggtatagacaatatgtatgtggaagccctcgagatgatgaaccaaaactagaagctagtgaaagagctggcnaangagtaccatgctttccttgcatctgcagctatcgataagcagattcctcgtcttctgggtcctggtcttaaaaggcaggacaattcccctacttggtgacagaccaggaatccttggagtgccaggttaacgagacaaaggctan

SEQ ID NO: 37974 - protein, 95 aa, Zea mays
  misc_feature: Ceres CLONE 1425127-F
MSKLQSDSLRDAIASITNDSREKQRKFVETIELRIALKNYDPSKDKRFSGSCKLPHIPRPKMKVCMLGDAHHAEEAETMGIDNMYVEALEMMNQN

SEQ ID NO: 37975 - DNA, 624 bp, Zea mays
  misc_feature: Ceres CLONE 1425137-F
  misc_feature: Translation starting site: 307
  misc_feature: SWISSPROT Homolog: EC 3.1.3.16 Phosphoprotein phosphatase
  misc_feature (449)..(449): n is a, c, t, g, unknown, or other
  misc_feature (451)..(451): n is a, c, t, g, unknown, or other
  misc_feature (452)..(452): n is a, c, t, g, unknown, or other
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaactacaagctctttggaggagtagagacttccagccatcccttctacgctctccccgttcccgtgtcgtcctcccgacaaagagggagccgctagggtttagcggcttccgcttctgggcgagggcttacccgcgagggacggcgcgacgcggcggcacttgagctagggtttccctccgatcccgttcctttcccggcgaggcgatggacgaggcggcgattgacgacttgatccggcggctcctcgaggcccgcggcgggcgcaccccgcgcaacgcgcaggtgactgacgccgagatcgggcgcctctgcgccaccgccaaggacgtttttctctcccagcccancnntctgnagctcgaggcccccataagatatgccgggatgtccatggccagtattcaaacctcccttcgattatttgagtatgggtggctatcccaccaaatgcaaattatcctgttcctgggggacatatggtgatccgggggaaaccaaccataaaaaccatttgcccttctt

SEQ ID NO: 37976 - DNA, 647 bp, Zea mays
  misc_feature: Ceres CLONE 1425138-F
  misc_feature: Translation starting site: 318
  misc_feature: SWISSPROT Homolog: EC 1.1.1.1 Alcohol dehydrogenase
  misc_feature: SWISSPROT Homolog: EC 1.1.1.2 Alcohol dehydrogenase (NADP(+))
aaactggagctccccgcggtggcggccgctctagaactagtggatcccccgggctgcaggaattcgcacgagaccattacctagaacatcctaatcgaaaaacatggtcttctcggtttggatcgattgctttcccatctgcttagggactgagggtcgtctcactcgcttcatccccctatcctggccacaaatgtgtggagctacggcacatgcctaaccgcggtgaaggagatcttctccaatatttccgcgggataagagcccccaccacactctgtcgcatcaaaaaggtggatgtaccgcctccgacgatcatggatgtgcgcgtcctgatcctcttctcctcgctctgccacactgacgtctacttctgggatggcaaagctcagactcccgtgttccctcaaatctttggacacgagctggagtcatcatagagaatgctgtacatggtgtgactgacgtacctcctggagaccatgtccttcctgtgttcactgccgagcgcaaggagtgtgccttctgcgagtccgcttacatcatgatgtgtgatctgcctcgtgatccagacgtacctcggtgtgatgattgccaatggacaaggactgcttttccatcaatgggcaggcctatctaccacttgg

SEQ ID NO: 37977 - DNA, 649 bp, Zea mays
  misc_feature: Ceres CLONE 1425139-F
  misc_feature: Encodes the peptide sequence at SEQ ID NO. 37978
  misc_feature (430)..(430): n is a, c, t, g, unknown, or other
caaagctggagctccccgcggtggcggccgctctagaactagtggatcccccgggctgcaggaattcgcacgagaccattacctagaacatcctaatcgaaaaaattaaccatattggccagtgtacgtgggaacgatggccctcatgcaggagagtagtagccaggatttgctccaagctcacgacgagctcttgcaccattccctgtgcttcgccaaatcgctcgcgctcgccgtggcgctagacctccgcatccccgacgcgatccaccaccacggggccggcggcgccacccttctccagatcctcgccgagactgcgctccacccaagcaagcttcgcgcccttcgccgcctcatgcgcgtgctcaccgtcacgggcatcttcagcgtcgtcgagcaccaccagcaggtggtggtgatgattcancccgtcacacgtcggacgacgaagctgtcgtcgtctacaggttgacgggaggcctcccgcttcctcgtcagcgacgaacgtgagcacggcgaccttggctcccttttgggagtctggcgcttcagcctatcccttgcctgttcccaccgccctgggtatctcccgccggggttccggaggaacaaacccaagccgtcccccgtatggccgggggtttcc

SEQ ID NO: 37978 - protein, 112 aa, Zea mays
  misc_feature: Ceres CLONE 1425139-F
  misc_feature (30)..(79): Pfam Name: Dimerisation Pfam Description: Dimerisation domain
  misc_feature: SWISSPROT Homolog: EC 2.1.1.146 (Iso)eugenol O-methyltransferase
  misc_feature (98)..(98): Xaa is any aa, unknown, or other
MALMQESSSQDLLQAHDELLHHSLCFAKSLALAVALDLRIPDAIHHHGAGGATLLQILAETALHPSKLRALRRLMRVLTVTGIFSVVEHHQQVVVMIXPVTRRTTKLSSSTG

SEQ ID NO: 37979 - DNA, 651 bp, Zea mays
  misc_feature: Ceres CLONE 1425142-F
aagctggagctccccgcggtggcggccgctctagaactagtggatcccccgggctgcaggaattcgcacgagaccattacctagaacatcctaatcgaaaaatttgcagatgactctacacgagtctcgataggaggaagactggaagacgacgctagcacttttgcggtgcccaccctcaccgtccactccagaacccctaatccagttccgttcctatcgccgagaagggcaccaaagggtacataaaaaaggaaatctatggcagcggccggagactagaacagactcgctggccagggcgagggcgagttctactgcgctactacgtgggagactggcctagttcgaatacgagttcctcgagttcgtagtcctccacgacgggcagctccgctacgccaacaactccaagtacgagaacgacaccatagatcgtgaagaggtcttcgtctcgacctccgtcgtccgcgaggccaggaggatcatccaggagtctgacttcatgacggatgactacttttactggcccgagccggatcgcatcggccgtcagtagctcgagatcgtcatgtgcaaccagcgcatttgattcaccactacgcagatcggctccctcatcgatgtccattccagcatagacccgcaggg

SEQ ID NO: 37980 - DNA, 641 bp, Zea mays
  misc_feature: Ceres CLONE 1425143-F
  misc_feature: Encodes the peptide sequence at SEQ ID NO. 37981
  misc_feature (514)..(514): n is a, c, t, g, unknown, or other
aaagctggagctccccgcggtggcggccgctctagaactagtggatcccccgggctgcaggaattcgcacgagaccattacctagaacatcctaatcgaaaagagaactagacgccactcctacagttttacgtttacccatcaccaccagtccagcaccgagcaccgaccagatcaaccaggcccgccccgacccgaagatgcagcggtggctcccggcgctcctccgccgcgccgcgcccggcggcggggcggcgcggctcttcgcctcgtcctccctcctcttcgacgacacgcaggagcagttcaaggagagcgtgcgcaagttcgcgcaggagaacatcgcgccgcgcgccgcggccatcgacgcctccaaccacttcccgcgggacgtggacctgtggaggctcatgggggacttcaacctccacggcctcaccgcgccggaggagtacggcggcatgggcctcggctacatgtaccactgcatctccatgggagagatcaccagggncctccgggcgcggtcggcctctcctacggggcgcactccaacctctgcaatcaccaagctggtccgggacgggaagtcccgaagcaaggctcaagtattctgccccagcttcatcagtgggggaaca

SEQ ID NO: 37981 - protein, 147 aa, Zea mays
  misc_feature: Ceres CLONE 1425143-F
  misc_feature (30)..(146): Pfam Name: Acyl-CoA_dh_N Pfam Description: Acyl-CoA dehydrogenase, N-terminal domain
  misc_feature: SWISSPROT Homolog: EC 1.3.99.10 Isovaleryl-CoA dehydrogenase
  misc_feature (105)..(105): Xaa is any aa, unknown, or other
MQRWLPALLRRAAPGGGAARLFASSSLLFDDTQEQFKESVRKFAQENIAPRAAAIDASNHFPRDVDLWRLMGDFNLHGLTAPEEYGGMGLGYMYHCISMGEITRXLRARSASPTGRTPTSAITKLVRDGKSRSKAQVFCPSFISGGT

SEQ ID NO: 37982 - DNA, 639 bp, Zea mays
  misc_feature: Ceres CLONE 1425147-F
  misc_feature: Encodes the peptide sequence at SEQ ID NO. 37983
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaaatcatacctccgaggctccgaccaaaacaccatggtcccagtgctcttggctctaagatggcggcgccggaaccggaggctaagctggaagccgtaaccccatctcggacccacgagctgacaccggagtccaaatccgacgcccctgcctccaccgggagccaggagctaaagccgagggagcagcacgccgcggtgatcaacctccagcgctaccactacggcgcagcagggtccctcctcctccgttcgcattccggcttcctcatcacgtgccccatcaagcgtgaaaaaagtgcaaccaacgaagccattcccatccttgaagaataccatgcaaattgctgtgttactgatcatgccgaaccatgtgatgagaaaaatgcaattaagacaagagaactgtgctcggaggcatcatgaagtttataacacgcagtaacgaatgggaatagaagcagtgtttcagactcaaatgagatcaccggacacacaagctcactccagtccaaggtgaatgacnatgatgacaggtct

SEQ ID NO: 37983 - protein, 121 aa, Zea mays
  misc_feature: Ceres CLONE 1425147-F
MAAPEPEAKLEAVTPSRTHELTPESKSDAPASTGSQELKPREQHAAVINLQRYHYGAAGSLLLRSHSGFLITCPIKREKSATNEAIPILEEYHANCCVTDHAEPCDEKNAIKTRELCSEAS

SEQ ID NO: 37984 - DNA, 658 bp, Zea mays
  misc_feature: Ceres CLONE 1425158-F
  misc_feature: Encodes the peptide sequence at SEQ ID NO. 37985
aaagctggagctccccgcggtggcggccgctctagaactagtggatcccccgggctgcaggaattcgcacgagaccattacctagaacatcctaatcaaaaactcttcttctgccttcccgactctacctgacttcgcccgctctgagaaattcactctcaccaccaccgcgccgcctccactccccccacacccccggtctgaaacccaagcttccgcttctctcatggccgacgccaccgccgccctctcagctcggagcaaggtgcacgctttcctggaggctgcgcgcgccggcgacctccaatccctcaagaacctcatcgcggcgctcgacgaggacggcacgggcgccgcctccgtcgccgccgccgtgcgtgacgacaacaagcgcaccgccctccacttcgcggagatctgatgtcgcaccgacgtctgtgaattcctcatcggcgagctcggcctccctgtcgacccaaaggacgatgatggcgaaactccgctcatccatgcaacacgccaggggcatctgcgacctgtcaagtatcttctcgaacatgggagctgatccttcggtggacaacagcctaagagccaagaggctacatcctgttggcgggataaggaaccacgaactcctgaagcttctcctctccaa

SEQ ID NO: 37985 - protein, 64 aa, Zea mays
  misc_feature: Ceres CLONE 1425158-F
MADATAALSARSKVHAFLEAARAGDLQSLKNLIAALDEDGTGAASVAAAVRDDNKRTALHFAEI

SEQ ID NO: 37986 - DNA, 611 bp, Zea mays
  misc_feature: Ceres CLONE 1425168-F
  misc_feature: Encodes the peptide sequence at SEQ ID NO. 37987
  misc_feature (302)..(302): n is a, c, t, g, unknown, or other
  misc_feature (308)..(308): n is a, c, t, g, unknown, or other
  misc_feature (309)..(309): n is a, c, t, g, unknown, or other
  misc_feature (328)..(328): n is a, c, t, g, unknown, or other
  misc_feature (333)..(333): n is a, c, t, g, unknown, or other
  misc_feature (334)..(334): n is a, c, t, g, unknown, or other
  misc_feature (359)..(359): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
ggagctccccgcggtggcggccgctctagaactagtggatcccccgggctgcaggaattcgcacgagaccattacctagaacatcctaatcgaaaaaggatccacatcttcccgagcgagttcttggttgacctcttcctcttcggaccacctccaaggctcttggtgtagcttgccactctcaccaatcaagttttcatggtctgatctcgacattcagatcccaactgccttcgatcccttcgctgaggccaatgctggggactctggtgcggcagcagggtcaaaggactacgtacacngtgcgnncatccagcagcgtaatggntcgcnnagaaccttgacaccgttcaagggantgaaaaaagaatttccaccttaccccaaaatccctcccaaaaattttcaaaaaaaaaaattttctccccaagagggagcaaaaaggggggnnnnnnncgccacccaaaatattgggggggttttttccccccggggggagaaaaaaaaaaaattttttttttttcccccccccccccctttataaaaaaaacgccctttttttttttttttttttaacacacccggcgcggtttaaaaaaaaaaccacccgg

SEQ ID NO: 37987 - protein, 56 aa, Zea mays
  misc_feature: Ceres CLONE 1425168-F
GAPRGGGRSRTSGSPGLQEFARDHYLEHPNRKRIHIFPSEFLVDLFLFGPPPRLLV

SEQ ID NO: 37988 - DNA, 611 bp, Zea mays; identical to SEQ ID NO: 37986
  misc_feature: Ceres CLONE 1425168-F2
  misc_feature (302)..(302): n is a, c, t, g, unknown, or other
  misc_feature (308)..(308): n is a, c, t, g, unknown, or other
  misc_feature (309)..(309): n is a, c, t, g, unknown, or other
  misc_feature (328)..(328): n is a, c, t, g, unknown, or other
  misc_feature (333)..(333): n is a, c, t, g, unknown, or other
  misc_feature (334)..(334): n is a, c, t, g, unknown, or other
  misc_feature (359)..(359): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other

SEQ ID NO: 37989 - DNA, 665 bp, Zea mays
  misc_feature: Ceres CLONE 1425171-F
  misc_feature: Encodes the peptide sequence at SEQ ID NO. 37990
aaagctggagctccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctggctggagagcagtttacatgaaaagataattgaggcatgcaacaaccttattgcaaagctcaagtaagtgaggtagtcacgaatggctcagttgatgaattccctgaatcacatttcccatatggctcggaacaacggttgggtggaaatgccccactggagtatgcaagctttacaataagatttggctcattgaatgtg

SEQ ID NO: 37990 - protein, 38 aa, Zea mays; identical to SEQ ID NO: 17402
  misc_feature: Ceres CLONE 1425171-F

SEQ ID NO: 37991 - DNA, 649 bp, Zea mays
  misc_feature: Ceres CLONE 1425176-F
  misc_feature: Translation starting site: 486
aaagctggagctccccgcggtggcggccgctctagaactagtggatcccccgggctgcaggaattcgcacgagaccattacctagaacatcctaatcgaaaaccatcgtccgcactcctcatcttatcccccgcctcctccggtcctcccgccgctgtagctcagttctgagtagcgacgcacgagctcccaagagctagccatggtgtccaccaacctctcctccgacttcaccctcctatcacgcccctccacctccccgtgccccgaagcctcgctcccaaggtcctcccacgcagcgccccacatccgacggggccgccgcgctcgtcgccgtcacgtgcaccgccacagagtcccccaagatcctggagctcggggacaccgtcgccgggctcactctcgaggaggccctcagactcgtcgaccacctccagaagaggatcagcgtcaccgccgcgggcttagcgccggccgccgtcgtaatggaaccctgtgcgggcggcggtgccccggctgaagaagacgaccccgtcgataacacggatctccacgtgatgatccaacaggtgcccagcagcgcgctgtatctccagtatcacggtggtgcgcgcgctcactagcctcgcgctgagagaggccaaggatc

SEQ ID NO: 37992 - DNA, 604 bp, Zea mays
  misc_feature: Ceres CLONE 1425186-F
  misc_feature (1)..(1): n is a, c, t, g, unknown, or other
  misc_feature (475)..(475): n is a, c, t, g, unknown, or other
  misc_feature (489)..(489): n is a, c, t, g, unknown, or other
  misc_feature (513)..(513): n is a, c, t, g, unknown, or other
  misc_feature (531)..(531): n is a, c, t, g, unknown, or other
  misc_feature (563)..(563): n is a, c, t, g, unknown, or other
  misc_feature (571)..(571): n is a, c, t, g, unknown, or other
naaagctggagctccccgcggtggcggccgctctagaactagtggatcccccgggctgcaggaattcgcacgagaccattacctagaacatcctaatcgaaaaatctccctgactcgcctcgtcctccagatatcggccgccaccttcacctccaccgccccggcgcacctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtccccctcccgtcgctctcacccaccgcttctatatcgccacctctctcgttgtagaagaagacactgaggatctgcaggctttctggaatcacatttnctgagaactatctngtggaagactaaactaggctcttnggtcatatatggatcagncagctaagaatgatgctgatttttctgaacanctgtactnctagatgagacacattacccaggagggtacaaa

SEQ ID NO: 37993 - DNA, 738 bp, Zea mays
  misc_feature: Ceres CLONE 1425198-F
  misc_feature (268)..(268): n is a, c, t, g, unknown, or other
  misc_feature (280)..(280): n is a, c, t, g, unknown, or other
  misc_feature (283)..(283): n is a, c, t, g, unknown, or other
  misc_feature (284)..(284): n is a, c, t, g, unknown, or other
  misc_feature (294)..(294): n is a, c, t, g, unknown, or other
  misc_feature (306)..(306): n is a, c, t, g, unknown, or other
  misc_feature (405)..(405): n is a, c, t, g, unknown, or other
aaagctggagctccccgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcanggtttgtataanggnnatctagatcntatcgactaccnggagagaaaaaaaaacaaaaataacgcgagaaagcatgagccacttcgccgccgccgcggtgaagaacccccctcgccgtggccgcccccccgccgggnaaccccaaaagccccgtctttttgcccaaggcgcggggccccccggggcgcccctggggggcccccaggggggggaaaccccgggtttgaattttccccacccctccccttgtaaaaacaaaggttttagggggtaaaaaaagggaacccctgacccccttttttttggggggaaaaaaaaaggggcccccccccctggagggggccttttagggcccccccccccccccaaaaaaaatttttgttgggggcgcccaaaaaaacccccccccccccctttttattttattttttttaaggggggcaaaaagccctccctcccccccccccccc

SEQ ID NO: 37994 - DNA, 718 bp, Zea mays
  misc_feature: Ceres CLONE 1425206-F
  misc_feature: Translation starting site: 252
aaagctggagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccaggctccgagactccgagtctcgatcgccccccgtcccctgcagcctgtgctctgggttggagggaggtgagctagcgagggagcgcggatggtgcgaggagatgagaggcagattcggcgaggaacagacttgcatgtgctggccctgcttctcctggaggcgcccgtccgcccggcctctccggctccggcggaggatggcctgctcagcattggtgactttgacacagcagcaagtcggtggttttgtaaaatctgcttcatgttgctgagggtgcatccccaatccctggttggacgatcttcggtccggttgatctcatttcggcatgccaacaccacggtggcatgatcctgtactgttccacaggggagacatgcactaaggctagggactgatgatggccttcgccatgaggcggacgttgacaaggactcggagtatgctgtctcattcaggctgccgggacatgtgcacaagtggatgcactgtaatgttgcgggctaagtggggggactcgcaccgaagacttgcctaggcttctaaagcttaaa

SEQ ID NO: 37995 - DNA, 682 bp, Zea mays
  misc_feature: Ceres CLONE 1425212-F
  misc_feature: Encodes the peptide sequence at SEQ ID NO. 37996
  misc_feature (311)..(311): n is a, c, t, g, unknown, or other
aaagctggagctccccgcggtggcggccgctctagaactagtggatcccccgggctgcaggaattcgcacgagaccattacctagaacatcctaatcgaaaatatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacngcgctcaaggccgcgacggccgcgacccttcgcgggtcgatgctggtgctgtccgggctgatcctggccggcgacgtgatcgcgctcacggtgggcacccccgtgctggtgatcttcacccgggcttggtggccggcccccatatcgcttgcgctcatgggcggccggggttcgtcacctcccgggggctccggggtccctgccctgtccgtgttttcccggaagtgacaaatacctgaaagggaaagcccccgccgggcgccgaaccaattggaacacgcccaagggaaaggtgggggtcccaaggccccccaaatccaggatggcggccaagcccccgcattcaacaagggcaaggggtctttaaaaaa

SEQ ID NO: 37996 - protein, 114 aa, Zea mays
  misc_feature: Ceres CLONE 1425212-F
MADHHRGATGGGGGYGDLQRGGGMHGEAQQQQKQGAMMTALKAATAATLRGSMLVLSGLILAGDVIALTVGTPVLVIFTRAWWPAPISLALMGGRGSSPPGGSGVPALSVFSRK

SEQ ID NO: 37997 - DNA, 748 bp, Zea mays
  misc_feature: Ceres CLONE 1425223-F
  misc_feature (698)..(698): n is a, c, t, g, unknown, or other
tggagctccccgcggtggcggccgctctagaactagtggatcccccgggctgcaggaattcgcacgagaccattacctagaacatcctaatcgaaaagttctctctccctccccctttcctctggtcatcgcacccgtctccccgctctgactccgcccgcgccgccgactcccggcacggccccccagggcttcatctcgccgccgccgtcgccgccgcctcgctccgatcgacccccgaaacgcggaaaccgtgggcttcgcgaggttgcctctctccgtcaagccgtaagatacataacagtgcgaccggggaaatgcaaaaaaaagggggggcatttgtcccttgcttgttggggaaagcccccatttcgcctgggtggatggggggccaaaacaatggggggatttctcgccatgggcaatccccggaagtttggggggggccaaaatgtgggggaaaaccctttataaagggaacccccccacgggggggcccctttaagggggggggaaacaacgacggggggggcggggccccccccaagagggggggccccccccccccccccagaggcgttttttttgttattatccggggggggggggaaattatttcttcgggaggggggggcctccccccccaaaaaaaaaatctgcgggaggttttttttctccccccccccccccgcaagaangatttggttgggggggggggtgttttttttctcccccccgccccccgccc

SEQ ID NO: 37998 - DNA, 643 bp, Zea mays
  misc_feature: Ceres CLONE 1425229-F
aaagctggagctccccgcggtggcggccgctctagaactagtggatcccccgggctgcaggaattcgcacgagaccattacctagaacatcctaatcgaaaaatcatcttgcttgactgcattctgcaaggggtgtggacccactgcatcctgcctgtcaatctcgatcgatcaaggggtggcgtgccgagatggaggtacggcagtcgcttcctgctctcattattgctatcttcgttcttgctggcagttactgccagcatgtccagctcggcctcatcagcgatggaatataacctgcacaggggaggatgagccagcaggccgacgactatgccgcgatgcgcgtcgaccgtgatggtgcccatcaccatcctcaagtccgctgtgtagcgactgatctgagtgcatggatggaacgccacctgcttaccacttggattctggctcctgagcgaggaccacaacctggattgtgaacttacacggatgtgcgaggtgcaacacctccactacatgccagatcaccaggagctcaggccgtggctcgacggaccacatgtacaaagagatccccttcaccggcatcatgaccagcagccctaccatgaatcctagtctctcccgattctaatttctacat

SEQ ID NO: 37999 - DNA, 640 bp, Zea mays
  misc_feature: Ceres CLONE 1425231-F
aaagctggagctccccgcggtggcggccgctctagaactagtggatcccccgggctgcaggaattcgcacgagaccattacctagaacatcctaatcgaaaagcctttggtgcaggttcagtgaagctctcctccttgtctcgagtctagccatggttccctgcttagggtggtgattctaaagtctacaggtctctgtacccctctccagttcatcgcatgccattcccctgtgctggtgaccacgcctgcagttctcccacctcgccatggctcggacgtcctaaggagttgctggcctggatgaagcttgtactgtaatcatctcagagctcccaaaatacagagtgaacattcaagatgaagtggttgctaaagaggagtctactccagtgcctgctcatcatgtggatggagctatctaactaaaggttgggtagaaggatctactacctcttcgctgcaataaggtgatgatgagtacactacctgttcctaaggctggaggacatttccagttctggaggaagattagttaggcttatgtataagctttggagggttcctacctttctgctattgtaataagttatgcactttgagtatatcaagacttgtaagacatgtaaccttcccaagt

SEQ ID NO: 38000 - DNA, 655 bp, Zea mays
  misc_feature: Ceres CLONE 1425237-F
  misc_feature: Encodes the peptide sequence at SEQ ID NO. 38001
tggagctccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaaaaagaagctcaagaggggcggcggcggcgggaggcgctcgttcgcggcggaggacgatgaggacttcgaggccgactttgaggtcttcgaggccgactccagtgattcagatttggagctcagggaggggactgacgacgacgtcgtcgagatcaagcccttcactgccaagaggactttctccagcgatggcttaagcaccatgactagtgctgtagcaaggtcagcccagaagaagagaaagaatctatacaggggtatccgccagcggccttggggcaagtgggctgctgagatcagagatcctcaaaagggtgttcctgtttgggcttgggaccttccataatcctgaaggagctgcaagagcttatgatgcccgagcc

SEQ ID NO: 38001 - protein, 141 aa, Zea mays
  misc_feature: Ceres CLONE 1425237-F
MCGGAILANLREPAPRRLTERDIWQQKKKLKRGGGGGRRSFAAEDDEDFEADFEVFEADSSDSDLELREGTDDDVVEIKPFTAKRTFSSDGLSTMTSAVARSAQKKRKNLYRGIRQRPWGKWAAEIRDPQKGVPVWAWDLP

SEQ ID NO: 38002 - DNA, 632 bp, Zea mays
  misc_feature: Ceres CLONE 1425243-F
  misc_feature: Encodes the peptide sequence at SEQ ID NO. 38003
tggagctccccgcggtggcggccgctctagaactagtggatcccccgggctgcaggaattcgcacgagaccattacctagaacatcctaatcgaaaagttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcaaaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcg

SEQ ID NO: 38003 - protein, 130 aa, Zea mays
  misc_feature: Ceres CLONE 1425243-F
  misc_feature (58)..(130): Pfam Name: PAP_fibrillin Pfam Description: PAP_fibrillin
MSTLTRRPLFSPGEFAVSRADFRVRVIDAKDELDPETSEGGSALLMAEEAIESVEETEVLKRSLVDSLYGTDRGLSASSETRAEIGDLITQLESKNPTPAPTDALFLLNGKWILAYTSFVGLFPLLSRGI

SEQ ID NO: 38004 - DNA, 665 bp, Zea mays
  misc_feature: Ceres CLONE 1425244-F
  misc_feature: Encodes the peptide sequence at SEQ ID NO. 38005
aaagctggagctccccgcggtggcggccgctctagaactagtggatcccccgggctgcaggaattcgcacgagaccattacctagaacatcctaatcgaaaaacgccctgccagagtccgacgcacgcctagggctcctggacacagcagagcccacgccttgactcgctccgttcgagtggagcgcacaggcaccggccggcgaccagagagggagcggatcgagggggctcggcttgagtggaggagatggaccgcaaggatgtcgggatcctcgccatggacatctacttcccgccctcctgcgtgcagcaagaagcacttgaggcccatgatggggcgagcaaaggcaagtacaccattgggcttgggcaagattgcatggccttttgcagcgaggtggaggatgtcatctcaatgagtttgacggttgtcaattctctgctgaaaaaatacaagattgatcccaagctaattggtcgcttggaggtgggaagtgaaacagttatagacaaaagcaaatccatcaaaacttggctgatgcacatttttgaggaaagtgataatactgacattgaaggtgttgactccagcaatgcatgttatggtgggacagcagccctactgaattgtgtgaattgcgtcgaaagtaactcctgagatgg

SEQ ID NO: 38005 - protein, 136 aa, Zea mays
  misc_feature: Ceres CLONE 1425244-F
  misc_feature (2)..(136): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
MDRKDVGILAMDIYFPPSCVQQEALEAHDGASKGKYTIGLGQDCMAFCSEVEDVISMSLTVVNSLLKKYKIDPKLIGRLEVGSETVIDKSKSIKTWLMHIFEESDNTDIEGVDSSNACYGGTAALLNCVNCVESNS

SEQ ID NO: 38006 - DNA, 641 bp, Zea mays
  misc_feature: Ceres CLONE 1425248-F
  misc_feature: Encodes the peptide sequence at SEQ ID NO. 38007
aaagctggagctccccgcggtggcggccgctctagaactagtggatcccccgggctgcaggaattcgcacgagaccattacctagaacatcctaatcgaaaaattccccacacgcgcccacctcctctgctctctcctctcccccacctctgcgtccgtgcgttgtgtttgtttaggcggcaaccgcgaggcgcaatgacgaccgggcgagagctggcggtgagtttcggcgagatgttgatagacttcatgcccaccgaggcgggggtctcgctggcggaggcgccggccttcctcaaggcgcccgggggcgcgcccgccaacgtcaccatcgcggtctcacgcctcggaggcggggccgcctttgtcggaaaactcggcaacgacgagttcggccgcatgcaccccgccatcctccgcaacaacagcgtcaacgacggcggcgtcgtcttcgactccggcgcgcgcaccgctctcgccttcgacaccctgcgcgccgacggggagcgcgagttcatgttctaccgcaaccccagagttgacatgctcctcaccgcagaccagctcaaagtctagctcatcaagagggctgcggtcttccactacggatcaataagcttgattgctgagccttgccggaa

SEQ ID NO: 38007 - protein, 126 aa, Zea mays
  misc_feature: Ceres CLONE 1425248-F
  misc_feature: SWISSPROT Homolog: EC 2.7.1.4 Fructokinase
MTTGRELAVSFGEMLIDFMPTEAGVSLAEAPAFLKAPGGAPANVTIAVSRLGGGAAFVGKLGNDEFGRMHPAILRNNSVNDGGVVFDSGARTALAFDTLRADGEREFMFYRNPRVDMLLTADQLKV

SEQ ID NO: 38008 - DNA, 639 bp, Zea mays
  misc_feature: Ceres CLONE 1425256-F
  misc_feature: Encodes the peptide sequence at SEQ ID NO. 38009
tggagctccccgcggtggcggccgctctagaactagtggatcccccgggctgcaggaattcgcacgagaccattacctagaacatcctaatcgaaaagagaactccatttcgatctcatttgaaatcaacccatcctcgtttcctccgtctagcagcctctcaccctcatggccaagatcgagatcgggatcaatgggtttggcaggatccgaaggctggtggccagggtggccctgcatagcgacgacgactagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcatgaaccctgaggagatcccatgaggttcggttggcgctgaatatgttgtagagtctactggagttttcactgaccagcagaaggctgcagctcacttgaagggtggtgccaagaaggttgtcatttctgctcctagcaaggatgcccacatgttcgttgttggtgtcaacgagaaggagtacaagtctgacatcaacattgtctctaatgctagctgcacaaccaac

SEQ ID NO: 38009 - protein, 46 aa, Zea mays
  misc_feature: Ceres CLONE 1425256-F
  misc_feature: SWISSPROT Homolog: EC 1.2.1.12 Glyceraldehyde-3-phosphate dehydrogenase (phosphorylating)
MTYMFKYDTVHGQWKHHEVKVKDSKTLLFGEKEVAVFGCMNPEEIP

SEQ ID NO: 38010 - DNA, 638 bp, Zea mays
  misc_feature: Ceres CLONE 1425258-F
  misc_feature: Encodes the peptide sequence at SEQ ID NO. 38011
aaagctggagctccccgcggtggcggccgctctagaactagtggatcccccgggctgcaggaattcgcacgagaccattacctagaacatcctaatcgaaaaaacgatcgtcaatgcaagtttggccattcacattggtctgaatactgtagctactaacgcgagtgccactgtgccgcagctgcctgctcaccattactgcaagctgtgttcaatcaaagcttaattacgctccctctacatctgatccagctaactagctagccagcactacaaaaaggcgtggcaagaatcaggagagaaatagtacgtgggctagctagctgagctcgtgcgacgaagaatggccagaattggcacgaacatggtggcgccgctcctggtgctcaacctcatcatgtacatcatcgtcatcggcttctcgagctggaacctgaaccacttcatcaacgggcagaccaactaccccggcgtggccggcaacggcgcgactttctacttcctggagttcgccatcctggccggcgtggtgggcccggcatccaaactggcgggcgtgcaccacgtgcgcgcctggcgccacgacagcatggtcaccaacgccgcgtcctcgctcatcgcctgggccatcacagacc

SEQ ID NO: 38011 - protein, 98 aa, Zea mays
  misc_feature: Ceres CLONE 1425258-F
  misc_feature (14)..(97): Pfam Name: AWPM-19 Pfam Description: AWPM-19-like family
MARIGTNMVAPLLVLNLIMYIIVIGFSSWNLNHFINGQTNYPGVAGNGATFYFLEFAILAGVVGPASKLAGVHHVRAWRHDSMVTNAASSLIAWAITD

SEQ ID NO: 38012 - DNA, 636 bp, Zea mays
  misc_feature: Ceres CLONE 1425271-F
  misc_feature: Encodes the peptide sequence at SEQ ID NO. 38013
ggagctccccgcggtggcggccgctctagaactagtggatcccccgggctgcaggaattcgcacgagaccattacctagaacatcctaatcgaaaaatccggtcccaaaagtagaaaagggcaagcgacgagcacagcacagcacgccttccgttttgggaaggcgaggagaggggaaccccggggagagttgggggatcggcggcggaggagatggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggtgactactaccgttacttggctgaatttagcactggaactgaaaagaaagct

SEQ ID NO: 38013 - protein, 141 aa, Zea mays
  misc_feature: Ceres CLONE 1425271-F
  misc_feature (4)..(141): Pfam Name: 14-3-3 Pfam Description: 14-3-3 protein
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKA

SEQ ID NO: 38014 - DNA, 631 bp, Zea mays
  misc_feature: Ceres CLONE 1425284-F
  misc_feature: Encodes the peptide sequence at SEQ ID NO. 38015
tggagctccccgcggtggcggccgctctagaactagtggatcccccgggctgcaggaattcgcacgagaccattacctagaacatcctaatcgaaaatttcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgataatctgaatgtgtggaggacccttttcttctagattttatcttcagctgtccttgtaagggttgtgttcaggttgagagttagcaggttgagctgtctatctgagaaccatttaaagttctctgagttttggtgtt

SEQ ID NO: 38015 - protein, 101 aa, Zea mays; identical to SEQ ID NO: 37086
  misc_feature: Ceres CLONE 1425284-F
  misc_feature (12)..(101): Pfam Name: Ribosomal_L35Ae Pfam Description: Ribosomal protein L35Ae

SEQ ID NO: 38016 - DNA, 641 bp, Zea mays
  misc_feature: Ceres CLONE 1425288-F
  misc_feature: Encodes the peptide sequence at SEQ ID NO. 38017
aaagctggagctccccgcggtggcggccgctctagaactagtggatcccccgggctgcaggaattcgcacgagaccattacctagaacatcctaatcgaaaaacttctacctggcctcgcaggcttcgcaagggggccacacgccgatacctcctcattcacccgctccgtcggcccccccagccggccacgccaccatgctgccaccggccgcacgccttgcggcccgccgcctcctcggcctcgcctccgcatctgcgtcggaagccgccggccgccgggtagcttcctctctgatcgcttacgcaggctactccgccgtcgcgtccaggggctccgtctacagtaccagggccttctccacggctcttaactaccaccttgactcgccagagaacaagccggacatgaaatgggagttctcacaggcgaatataaagaaggtctatgagattctgtctcactatgcgagctactacaagcaatctggtattattccgctgcttgatcttgcacagcagcaacatggttgatgggtgccacttgcagcaatggatgctattgctaaaattgtccaagttgcaccaatcaggggctatgaagtagcatccttctatacagagcttaacaggactaacgtt

SEQ ID NO: 38017 - protein, 111 aa, Zea mays
  misc_feature: Ceres CLONE 1425288-F
  misc_feature: SWISSPROT Homolog: EC 1.6.99.5 NADH dehydrogenase (quinone)
MLPPAARLAARRLLGLASASASEAAGRRVASSLIAYAGYSAVASRGSVYSTRAFSTALNYHLDSPENKPDMKWEFSQANIKKVYEILSHYASYYKQSGIIPLLDLAQQQHG

SEQ ID NO: 38018 - DNA, 652 bp, Zea mays
  misc_feature: Ceres CLONE 1425295-F
  misc_feature: Translation starting site: 512
  misc_feature: SWISSPROT Homolog: EC 1.11.1.15 Peroxiredoxin
aaagctggagctccccgcggtggcggccgctctagaactagtggatcccccgggctgcaggaattcgcacgagaccattacctagaacatcctaatcgaaaaagcagtcggatagcctggaagcccgtgcacgtcgaccgacgtatgccaccatttcggggctaaccataggctacgccgtccccaacctggaggtggactccacccacgggaggatccgcatccacgactacgttggcgacggctacgccgtcatcttctctcacccagccgacttcacccccgtgtgcacaacagatatggcggcgatggcggcgtatgccaaggacttcgagaaccgtggcgtgaacgctgctgcgtttctcgtgcgacgacgtggagatcgcacaagctctgtatctaggacgtggaggcggacggcgggaagcaactgcactcgcagcatacgacgacgaaggtgacgttcccgatcctggagtatccggtgagggacgccatccggcagctgaacatggtggaccccgacgagaacgactcgtctcggctgatcatgccgtaccacgcgctccacgtcgtctggcccgacaaggccgatgagctgagcttcctgtaccccgccaccactgggcggaacatggatgaggtgctgcgt

SEQ ID NO: 38019 - DNA, 749 bp, Zea mays
  misc_feature: Ceres CLONE 1425297-F
  misc_feature: Encodes the peptide sequence at SEQ ID NO. 38020
  misc_feature (271)..(271): n is a, c, t, g, unknown, or other
  misc_feature (272)..(272): n is a, c, t, g, unknown, or other
  misc_feature (317)..(317): n is a, c, t, g, unknown, or other
  misc_feature (354)..(354): n is a, c, t, g, unknown, or other
  misc_feature (360)..(360): n is a, c, t, g, unknown, or other
aagctggagctccccgcggtggcggccgctctagaactagtggatcccccgggctgcaggaattcgcacgagaccattacctagaacatcctaatcgaaaaatcaacggaacggagcgcaacgcaatcctatgtcaggcgcgcaaggagctcagccgaagggcgccttcacggcgaccacctacacatcggctgcgcccaccggtggcggcgccggcgcggcccaggggcaggggcaggggcaagaccaccagagagacggcagactccgnncgacgagctccggtcggccgaagacgagcgcgggctgcctgtcangaagctggagaccccgtcaagatgccccgggcaaggncggccnggtgttccgcccggccccgaacaaggggaccccgaattctcggtccccggaccgggtggaagctaccggattggcttcttgaagtgcccctcctttccaagggggattcccaaaggaaaaacccagggattgccccccccaaaagggcaacaaacgggcgcggaaaaaaattggaaaaaaaatcgggcgcgaaaaaaaaaacccttttttttcgccgttttaaaaaaaagggggaataataagaaaaaccttttaaaaaaaatataaatatattcccccccccccccccggttggttaaaacccccgcgggaaataaaaaaaatatcccccccccaaaaaaaaaaaaaaaactttttctccccccccccccccgggggggggggccccc

SEQ ID NO: 38020 - protein, 103 aa, Zea mays
  misc_feature: Ceres CLONE 1425297-F
  misc_feature (48)..(48): Xaa is any aa, unknown, or other
  misc_feature (63)..(63): Xaa is any aa, unknown, or other
  misc_feature (75)..(75): Xaa is any aa, unknown, or other
  misc_feature (77)..(77): Xaa is any aa, unknown, or other
MSGAQGAQPKGAFTATTYTSAAPTGGGAGAAQGQGQGQDHQRDGRLRXTSSGRPKTSAGCLSXSWRPRQDAPGKXGXVFRPAPNKGTPNSRSPDRVEATGLAS

SEQ ID NO: 38021 - DNA, 660 bp, Zea mays
  misc_feature: Ceres CLONE 1425302-F
  misc_feature: Encodes the peptide sequence at SEQ ID NO. 38022
aaagctggagctccccgcggtggcggccgctctagaactagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactccccgtggcctccgcacactcaactctgtttgggcccaacatcttaacgaagaagtgaggagaagggtctacaggaactggtgccagagcaagaagaagggtttcccaaaggatgctctccaataagaaaatgatgctgggaagaaggaaattccgctgccgcttgggaagatgaagaaatatggtttttgttatccctggtcattgcccccaacccagattaag

SEQ ID NO: 38022 - protein, 136 aa, Zea mays
  misc_feature: Ceres CLONE 1425302-F
  misc_feature (50)..(136): Pfam Name: Ribosomal_L3 Pfam Description: Ribosomal protein L3
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLNSVWAQHLNEEVRRRVYRNWCQSKKKGFPKDALQ

SEQ ID NO: 38023 - DNA, 616 bp, Zea mays
  misc_feature: Ceres CLONE 1425306-F
  misc_feature (221)..(221): n is a, c, t, g, unknown, or other
  misc_feature (222)..(222): n is a, c, t, g, unknown, or other
  misc_feature (238)..(238): n is a, c, t, g, unknown, or other
  misc_feature (242)..(242): n is a, c, t, g, unknown, or other
  misc_feature (559)..(559): n is a, c, t, g, unknown, or other
tggagctccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacnngccgcggcgccctggncggncaggccccgggggaaagtacctttggcccttaacccccgaagggcctttttcccccacaaaaaaaagaggggggggccccccgcccccccccggcccccggggggcctctttttttaccccggcgccccccccccggggggggggttttttttttttaaggggggggggaaccccccccttttttttttttcccccccccccccccggggggggggggggcggcccccccccccccccccccccccaaaaaaaaaaaaaaaaaaaaggcccccccccccccaaaaaaaagaaaaaccccctcccctccccccccccntttgttgggggggagaaaagagatttttgtttttgtgggggggcggccccgcccccc

SEQ ID NO: 38024 - DNA, 630 bp, Zea mays
  misc_feature: Ceres CLONE 1425308-F
  misc_feature: Encodes the peptide sequence at SEQ ID NO. 38025
aaagctggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagaatcctcccggtgagcggggcccggcagagccgcagcggcggcgtcgccgtgcgggcgtcgctgttctcgcccaagcccgcggcggccaaggacgcgcggccgaccaaggtgcaagagctgtacgtgtacgagatcaacgagcgggaccgcgagagccccgcgtacctgcgcctcagcgccaagcagacggagaacgcgctgggcgatcttgtccccttcaccaacaaggtgtacaacggcagcctggacaagcggctgggcgtcaccacgggcatctgcgtgctcatccagcacgtccc

SEQ ID NO: 38025 - protein, 128 aa, Zea mays
  misc_feature: Ceres CLONE 1425308-F
  misc_feature: SWISSPROT Homolog: EC 5.3.99.6 Allene-oxide cyclase
MAAALRCPASVRVSGPAAAGLAKVRQASRILPVSGARQSRSGGVAVRASLFSPKPAAAKDARPTKVQELYVYEINERDRESPAYLRLSAKQTENALGDLVPFTNKVYNGSLDKRLGVTTGICVLIQHV

SEQ ID NO: 38026 - DNA, 647 bp, Zea mays
  misc_feature: Ceres CLONE 1425319-F
  misc_feature: Encodes the peptide sequence at SEQ ID NO. 38027
aagctggagctccccgcggtggcggccgctctagaactagtggatcccccgggctgcaggaattcgcacgagaccattacctagaacatcctaatcgaaaaatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcatcgtggatccacatccggtcgctcctcgccgccgccgcgtcctcgtcctcgtcctcctccttcgcagcggctgcggctgggagcgcggtggctgtggtgtcggctgcggtggccgcctcgtcttcttcctcgccggcgtcgtcctcgccgcactcggagcggggtggtcttaaatctccatggtcccggaggaaaagaaaacgagcactttctcgtgaacagtgggagagtttgttttcagcaaatgggaagcttcgtgatggtggaaggaagt

SEQ ID NO: 38027 - protein, 113 aa, Zea mays
  misc_feature: Ceres CLONE 1425319-F
MKALRRSSTSSSPTAASSPPSSSWIHIRSLLAAAASSSSSSSFAAAAAGSAVAVVSAAVAASSSSSPASSSPHSERGGLKSPWSRRKRKRALSREQWESLFSANGKLRDGGRK

SEQ ID NO: 38028 - DNA, 516 bp, Zea mays
  misc_feature: Ceres CLONE 1425335-F
  misc_feature (1)..(1): n is a, c, t, g, unknown, or other
  misc_feature (238)..(238): n is a, c, t, g, unknown, or other
  misc_feature (239)..(239): n is a, c, t, g, unknown, or other
naaagctggagctccccgcggtggcggccgctctagaactagtggatcccccgggctgcaggaattcgcacgagaccattacctagaacatcctaatcgaaaaacggttgagcgaagtcgtcactgtaatctactgatctgcaaatggcggaggcggaggcggaggcgacggtggggcgactgatgctgtactcgtactggcgcagcgcgtgctcccaccgtgccccgcatcgctctnncatctcaaggtgtgggattacgagtacaaggcggttgaaaccttttctcagggcgagcagtctggatccagaattcgtcaagctttaatcctatgaagttcgtccctgccttggtccatgggcctttctgtaataagttgacccccttacccgaaagccccgttttttttggaggggacaaatcccccaaactctccctttttttccctcaaaaacttttaaaaaaaaaacctttttgaacccccccaattttttcggcctttttttaactctttcc

SEQ ID NO: 38029 - DNA, 658 bp, Zea mays
  misc_feature: Ceres CLONE 1425347-F
  misc_feature: Encodes the peptide sequence at SEQ ID NO. 38030
  misc_feature (24)..(24): n is a, c, t, g, unknown, or other
  misc_feature (316)..(316): n is a, c, t, g, unknown, or other
  misc_feature (319)..(319): n is a, c, t, g, unknown, or other
  misc_feature (616)..(616): n is a, c, t, g, unknown, or other
gctctagaactagtggatcccccngggctgcaggaattcgcacgagaccattacctagaacatcctaatcgaaaaacccccaggccccagccccccattcctgcctcttctctctctcgcccacccgccccggccccaatgtcgccgcccctcgagccccacgactacatcggcctctccgccgccgccgcggcgccgccgaccccgacctcctcctcgtcgtcctcgtcctcgccggggccccgcctcaccctccgcctcggcctgccgggctccgagtcccccgaccgcgaccgctacagctacaaggaaatcnccnccgggctctccctcggcccgcttcctgctacccccaaggcgcccgctgccgtcaagagcaccctcgccttcccggattccttccaaggccccggccctgcccaggctagcgacgagggggagggctttcccggcgcggcgccgggccccagggtgcaggggggggggaagaccccacgggccgaactaaccggaaaaaccccttctccgctagggccttcccgaagcaaggcgtgaggggtccgggggcgggggaggccgctttcgccggccccggcccatgtacctggaaggcgantcaaagagtgcctccccctcacccccaggaagggggaacaaa

SEQ ID NO: 38030 - protein, 138 aa, Zea mays
  misc_feature: Ceres CLONE 1425347-F
  misc_feature (60)..(60): Xaa is any aa, unknown, or other
  misc_feature (61)..(61): Xaa is any aa, unknown, or other
MSPPLEPHDYIGLSAAAAAPPTPTSSSSSSSSPGPRLTLRLGLPGSESPDRDRYSYKEIXXGLSLGPLPATPKAPAAVKSTLAFPDSFQGPGPAQASDEGEGFPGAAPGPRVQGGGKTPRAELTGKTPSPLGPSRSKA

SEQ ID NO: 38031 - DNA, 634 bp, Zea mays
  misc_feature: Ceres CLONE 1425356-F
  misc_feature: Encodes the peptide sequence at SEQ ID NO. 38032
aaagctggagctccccgcggtggcggccgctctagaactagtggatcccccgggctgcaggaattcgcacgagaccattacctagaacatcctaatccaaaaacggatccaccggagagatctggtctgccattcccacgctccttcctgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggctaagcatcccaagacagacgtgtaccagtgtttcccccatctgaagaagtgaaaggcctgaacttagcaaccagcgctggtttggtcactacgatcgggcccaggggcgtttcttggggttaagggggtccattcctgttaacttccctcagcaaggggcctggccaaggtaacccaaaaaaaaggagggggggccattttagggaaaacggc

SEQ ID NO: 38032 - protein, 77 aa, Zea mays
  misc_feature: Ceres CLONE 1425356-F
  misc_feature (4)..(73): Pfam Name: DUF1909 Pfam Description: Domain of unknown function (DUF1909)
MGGGNGQKSKMARERNLEKNKGAKGSQLETNKKAMSIQCKVCMQTFMCTTTEVKCREHAEAKHPKTDVYQCFPHLKK

SEQ ID NO: 38033 - DNA, 629 bp, Zea mays
  misc_feature: Ceres CLONE 1425358-F
  misc_feature: Encodes the peptide sequence at SEQ ID NO. 38034
  misc_feature (629)..(629): n is a, c, t, g, unknown, or other
ctggagctccccgcggtggcggccgctctagaactagtggatcccccgggctgcaggaattcgcacgagaccattacctagaacatcctaatcgaaaaacgccctgccagagtccgacgcacgcctagggctcctggacacagcagagcccacgccttgactcgctccgttcgagtggagcgcacaggcaccggccggcgaccagagagggagcggatcgagggggctcggcttgagtggaggagatggaccgcaaggatgtcgggatcctcgccatggacatctacttcccgccctcctgcgtgcagcaggaagcacttgaggcccatgatggggcgagcaaaggcaagtacaccattgggcttgggcaagattgcatggccttttgcagcgaggtggaggatgtcatctcaatgagtttgacggttgtcaattctctgctgaaaaaatacaagattgatcccaagctaattggtcgcttggaggtgggaagtgaaacagttatagacaaaagcaaatccatcaaaacttggctgatgcagatttttgaggaaagtgataatactgacattgaaggtgttgactccagcaatgcatgttatggtgggacagcagccctactgaattgn

SEQ ID NO: 38034 - protein, 127 aa, Zea mays
  misc_feature: Ceres CLONE 1425358-F
  misc_feature (2)..(128): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
MDRKDVGILAMDIYFPPSCVQQEALEAHDGASKGKYTIGLGQDCMAFCSEVEDVISMSLTVVNSLLKKYKIDPKLIGRLEVGSETVIDKSKSIKTWLMQIFEESDNTDIEGVDSSNACYGGTAALLN

SEQ ID NO: 38035 - DNA, 862 bp, Zea mays
  misc_feature: Ceres CLONE 1425364-F
  misc_feature (12)..(12): n is a, c, t, g, unknown, or other
  misc_feature (57)..(57): n is a, c, t, g, unknown, or other
gggggggggccncccccccttcttttccggggaagggaagggaaaaatggctcaacnaggaactggccgccctggcggcggctctagaatagtggatcccccggcctgcaggagttggcacgagaccattacctacaacatcctaatcgaaaataaagatgctgctccctcctcctcctccagaaacttcacccatggcggcttcttctgctctctcctcacaccttcttctctccaacgaccgctctcctccatcatgcggctccgtcagacgttctatcacctgctcccgggtgctcagccctactcccagatcgtctcgatggagctccacaatacctgaaaggataagcgtcgtctctgaaatcaacacgtcgcgggagagtctccttgtcgtctaaccgggcaactttcgagcacataatggagggaaatctgaattccccccaaacccccaactcacgtgtaggggaggttctcggggctttagaaccccaggcagtttggtggcgcacacgtcatcaacgatcgtatctggaaggtggctggcaaccccgcccagagctaggagtggggtgtggaaagaagagtgtgggaggcaaccctggggggattctaataaccaaaggaagcctgtgcaaccaatgggccaccatgcaaacaagacagcggccagcccttccaaaggtcgggcgagctaaccttcgttcgcgggtgcttcctaccgtgaggtaaggacggcccccggagctgcagccccatcgaggttcggcggggggagttgaccagtatacaatcggcgcccccagagctgcatttcaggaacgcgccccccaggctgtcttgcaacccaaggggtgtg

SEQ ID NO: 38036 - DNA, 668 bp, Zea mays
  misc_feature: Ceres CLONE 1425368-F
  misc_feature: Encodes the peptide sequence at SEQ ID NO. 38037
ctggagctccccgcggtggcggccgctctagaactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacgacggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcttgcaaatgttggcgctgaactggctcatcaagtccctgggagagtttcgacggaaatagatgctcggttagcttatgacacccagggcataatccacagggtacatgaactgttg

SEQ ID NO: 38037 - protein, 175 aa, Zea mays
  misc_feature: Ceres CLONE 1425368-F
  misc_feature: SWISSPROT Homolog: EC 2.2.1.2 Transaldolase
MALSIYTPTSSSLVPPSIQEVRLTSRPPKPATFSLRRPHLAARAAAGNAPTSPVREVVTELDAVAGFSEIVPDTVVFDDFERFAPTTATVSSSLLLGITGLPDTKFKSAIDTALADGECNALEKAEDRMSCYLTKALANVGAELAHQVPGRVSTEIDARLAYDTQGIIHRVHELL

SEQ ID NO: 38038 - DNA, 651 bp, Zea mays
  misc_feature: Ceres CLONE 1425370-F
  misc_feature: Encodes the peptide sequence at SEQ ID NO. 38039
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatgcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatcggtgaacaggtgaagggcatgctccacgacaaggggccgacggcgtctcacgcgctgacggtggtgacgctgttcccgctgggcgggctgctgctggtgctgtcggggctggcgctgacagcctccgtggtggggctggccgtggccacgccggtggtcctgatcttcagcctcgtgctcgtacccgccacgctgctcatcgggacggccggcatggggtatctcacgtcgggcgcgctggagctcgagggcctgtcctcgctcacgtgcctcgacaacacggcacggcaggcgttccagcgcaccccggactacgtggaagaggcacaccccaggatggctgatgccgcagcgc

SEQ ID NO: 38039 - protein, 148 aa, Zea mays
  misc_feature: Ceres CLONE 1425370-F
  misc_feature (44)..(147): Pfam Name: Oleosin Pfam Description: Oleosin
MADRDRSGIYGGAHATYGQQQQQGGGGRPIGEQVKGMLHDKGPTASHALTVVTLFPLGGLLLVLSGLALTASVVGLAVATPVVLIFSLVLVPATLLIGTAGMGYLTSGALELEGLSSLTCLDNTARQAFQRTPDYVEEAHPRMADAAA

SEQ ID NO: 38040 - DNA, 677 bp, Zea mays
  misc_feature: Ceres CLONE 1425377-F
  misc_feature: Encodes the peptide sequence at SEQ ID NO. 38041
  misc_feature (243)..(243): n is a, c, t, g, unknown, or other
  misc_feature (257)..(257): n is a, c, t, g, unknown, or other
aagctggagctccccgcggtggcggccgctctagaactagtggatcccccgggctgcaggattcgcacgagaccattacctagaacatcctaatcgaaaaaccattcctttctctccctctcgccgtcgtcgccacctccacttggccccgctcatcgcctcctccgacgaccaccgtccaccggcgacaaggacagcgacgatgcagtcggcggcgtggaggcgtcacctccctcgacaccnactctccctttaanctcggggctgcatcgcgccttcagattccgcctcccaagcccggggctcgctccccaggggttgtttggagcggatggcccagatgcatgtttgcaagggccccgggggtcaaggggtccgggcattcttccccaagggccccgggaggagggccttctggaggggaattttacccccccgggttttgggaaacccggggttttttggggggccttttttggggaccacctctccaaaaagggggcccaagggtgtttcccccataaagggggggggggattcccccccccccccaaaaaattgggggggcctgggggaaaaatttccccccaaaaaaacccccccgagaggggtgttttttttagagggggtgggggcccccaaaaaaaagggtgtttatttccccaccaaaaaaaaaa

SEQ ID NO: 38041 - protein, 115 aa, Zea mays
  misc_feature: Ceres CLONE 1425377-F
MAQMHVCKGPGGQGVRAFFPKGPGRRAFWRGILPPRVLGNPGFFGGPFLGTTSPKRGPKGVSPIKGGGDSPPPPKNWGGLGEKFPPKKTPPRGVFFLEGVGAPKKKGVYFPTKKK

SEQ ID NO: 38042 - DNA, 542 bp, Zea mays
  misc_feature: Ceres CLONE 1425392-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (192)..(192): n is a, c, t, g, unknown, or other
  misc_feature (196)..(196): n is a, c, t, g, unknown, or other
  misc_feature (387)..(387): n is a, c, t, g, unknown, or other
  misc_feature (394)..(394): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaagctggggacttccaccgncggntggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaacccacaaaagcaatggccgccgccgtccgcaaacggggncaaccgncgcccgccgccggcgggaagggaaaaacatgttccccgggcggaaggcccaagcttgggccaattaattggaacctgggcaaaacctgggggtcccgggggccccaaatggggccttgggggggccccttgaattcccggctgggggg

SEQ ID NO: 38043 - DNA, 662 bp, Zea mays
  misc_feature: Ceres CLONE 1425393-F
  misc_feature: Encodes the peptide sequence at SEQ ID NO. 38044
aaagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaagtggagtcctcatacaacattgacaatgtccaagcaaagatccaggacaagggaaggcatccccactgaccaggaacgtctcatccttgccggcaagcaattggaagataggcaggacccttgctgactaacacattcagaaaggagagcaccctcccactgtgtgctgcgtcctaaa

SEQ ID NO: 38044 - protein, 114 aa, Zea mays
  misc_feature: Ceres CLONE 1425393-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSYNIDNVQAKIQDKGRHPH

SEQ ID NO: 38045 - DNA, 656 bp, Zea mays
  misc_feature: Ceres CLONE 1425396-F
  misc_feature: Encodes the peptide sequence at SEQ ID NO. 38046
  misc_feature (563)..(563): n is a, c, t, g, unknown, or other
  misc_feature (617)..(617): n is a, c, t, g, unknown, or other
aagctggagctccccgcggtggcggccgctctagaactagtggatcccccgggctgcaggaattcgcacgagaccattacctagaacatcctaatcgaaaagttttccaacacagcgaggcccacgttgtagggttttttgcttgcttcgcccggcggtaaagctgagcgcggcgagagccggagaccgaagaagcgccgcccgccgcgcgcccggtcatggagatcggacagtaccccgagagcggctgctccgaggagcaccgtatcatctaccgggagtggttcgcgctcgcggacgcagatggggatggccgcatcacgggccacgatgcgatccagttttttggcatgtccaagctctcacgccctgacctcaagcaggtctgtgctatcgacgacaccagaacgcaagcgtatctgggtttctctgaattcgtcacggcgatgcaactagtctctctggcaccagcgggcaacgatgatactcatgatagccttaagccacatgatgtgcagcagttgaatccacctgtgatggaacgtttgtatgccctacttgcnaaaactaagcatttcgatgaagcgtgctcgatcaaaaatgaatggatatcctcntgaacaatctcctttaacaaacgagtggtttagctcgag

SEQ ID NO: 38046 - protein, 133 aa, Zea mays
  misc_feature: Ceres CLONE 1425396-F
MEIGQYPESGCSEEHRIIYREWFALADADGDGRITGHDAIQFFGMSKLSRPDLKQVCAIDDTRTQAYLGFSEFVTAMQLVSLAPAGNDDTHDSLKPHDVQQLNPPVMERLYALLAKTKHFDEACSIKNEWISS

SEQ ID NO: 38047 - DNA, 631 bp, Zea mays
  misc_feature: Ceres CLONE 1425397-F
aagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacacggtctcctctcctgcaaagaggtacgtaactgcactttcctgctcagtcttttgatcggtttcagtgatgcactgatgatgtagagtttcgattctgttagtactctaatcaacggacaacggtttatgttagtattcttggattcatggctgtctgcagattgtcgcccttgctctgcctgctctattcggcctcaattcattctgacgaaaacctcacctcgtaactgaaataagccatatgcgccgcgcgtcaaatcttagtgtctgatcaatacgctatccctacaattttctgagctgttgaactcctgcacccgtctcctcgtcgaggacaggaagatgagctcgctacacgccacacgagcggagcttggcctggttgtcctgtacctgagcccagccgaggcccgggactagatctgtagggcgatcca

SEQ ID NO: 38048 - DNA, 674 bp, Zea mays
  misc_feature: Ceres CLONE 1425406-F
  misc_feature: Encodes the peptide sequence at SEQ ID NO. 38049
aaagctggagctcaccgcggtggcggccgctctagaactagtggatcccccgggctgcaggaattcgcacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagcctcatgtctactcctgctgtatctgctgtcatccgtgaaagagttgtgcagatggatcaaaggctactggtgccttcatcttgacagcgagcc

SEQ ID NO: 38049 - protein, 120 aa, Zea mays
  misc_feature: Ceres CLONE 1425406-F
  misc_feature (16)..(121): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVVQMDQRLLVPSS

SEQ ID NO: 38050 - DNA, 644 bp, Zea mays
  misc_feature: Ceres CLONE 1425408-F
  misc_feature: Encodes the peptide sequence at SEQ ID NO. 38051
aaagctggagctccccgcggtggcggccgctctagaactagtggatcccccgggctgcaggaattcgcacgagaccattacctagaacatcctaatcgaaaaacgccgcatacgcgtgacaactgtggcacggagaccggattcctcacgcctgctggcgtcgatctcctccggaggctgcttctcaccgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcatcgacatgtgtgattatgctgtggggctaagtcgccaactaaatggatccattataccatctgaacgaccaaaccatatgatgatggaggtgtggaatccccttggagttgtgggtgttataacggcatttaatttcccttgtgctgtgcttggttggaatgcttgcattgctttggtctgtggaaattgtgtcgtctggaaaggtgctccaacaactccactgatcactattgcaatgacaaaaatagtggctagtgtattggagaagaaacacttgccaggcgcaatttttacatctttttgtgggggcactg

SEQ ID NO: 38051 - protein, 120 aa, Zea mays
  misc_feature: Ceres CLONE 1425408-F
  misc_feature: SWISSPROT Homolog: EC 1.2.1.3 Aldehyde dehydrogenase (NAD(+))
MGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLEKKHLPGAIFTSFCGGT

SEQ ID NO: 38052 - DNA, 666 bp, Zea mays
  misc_feature: Ceres CLONE 1425414-F
  misc_feature: Encodes the peptide sequence at SEQ ID NO. 38053
aaagctggagctccccgcggtggcggccgctctagaactagtggatcccccgggctgcaggaattcgcacgagaccattacctagaacatcctaatcgaaaaccttcgatcgctccggcgaatccctttatcatgtcaataggagcgatgcaggagatcgaagagactgctccgttaatcgacgattctcaacccagcggcgaaacgagatcgcaatccgcgacgacgaaggtgccggaggtggagatccatctgtatcgaagtgggaaaggtccgatcgacgtgttcaaatcgaatctcggaggttgggagcaggatcagctcgaggttcgagctattctcgagaaatacggattgaaatcgatcttcgctttcaacgtcgagaaaggtcgaggcgtcccgatccgatttcaaaggaatggccggtctgtgctgacgtacagagatggtgccaccgtttacatcgacggcgaacctcaggattctatgatccaacccatcacaagaatcgtgctcggagtagtgattgctacgctgttaataacgtttctaatgaaggacccgccagcgtggatcaagaacaacatctccattgggaacttccctccgtgcgtgctcgcgtgcatagtaatagtattcacccgagcgaggaagagaaccagatac

SEQ ID NO: 38053 - protein, 178 aa, Zea mays
  misc_feature: Ceres CLONE 1425414-F
MSIGAMQEIEETAPLIDDSQPSGETRSQSATTKVPEVEIHLYRSGKGPIDVFKSNLGGWEQDQLEVRAILEKYGLKSIFAFNVEKGRGVPIRFQRNGRSVLTYRDGATVYIDGEPQDSMIQPITRIVLGVVIATLLITFLMKDPPAWIKNNISIGNFPPCVLACIVIVFTRARKRTRY

SEQ ID NO: 38054 - DNA, 649 bp, Zea mays
  misc_feature: Ceres CLONE 1425417-F
  misc_feature: Encodes the peptide sequence at SEQ ID NO. 38055
  misc_feature (577)..(577): n is a, c, t, g, unknown, or other
agagctggagctccccgcggtggcggccgctctagaactagtggatcccccgggctgcaggaattcgcacgagaccattacctagaacatcctaatcgaaaaataggacgaactaccgatgcaagctgcgatcgatcagtcaccgcatctccggttccgcgcaggcatggacgacaagtcctgctacgtggcaaccggcctctccctggcggccatcctcctcgtcctccaccgcctcgtggtccgtgctggcggcaaggggaacgccgccgcgcggcggctgcctcctagccctcccgccgtcccgttcctcgggcacctccacctgctagcgtcggagtgccctctccactcgtcgctggcccgcctcgcggcgcgccacggccccgtgctctcgctgcgcctgggatctcgcgccgccgtgatggtgtcgtcgccggagtgcgccaaggcgtgcttcacggagcacgacgtggagttcgccaaccgccccaggctgacctcgcaggcgctggcctccttcggcggcgcagcgctggccgtgtccaactacgggcctactggagcaacctcggcncgtgaccgcatgcacctcctatcacgcacagcggggctgcatgtgccccgtcctctccgccgaagtgcgcgc

SEQ ID NO: 38055 - protein, 161 aa, Zea mays
  misc_feature: Ceres CLONE 1425417-F
  misc_feature: SWISSPROT Homolog: EC 1.14.13.88 Flavonoid 3',5'-hydroxylase
MDDKSCYVATGLSLAAILLVLHRLVVRAGGKGNAAARRLPPSPPAVPFLGHLHLLASECPLHSSLARLAARHGPVLSLRLGSRAAVMVSSPECAKACFTEHDVEFANRPRLTSQALASFGGAALAVSNYGPTGATSARDRMHLLSRTAGLHVPRPLRRSAR

SEQ ID NO: 38056 - DNA, 656 bp, Zea mays
  misc_feature: Ceres CLONE 1425421-F
  misc_feature: Encodes the peptide sequence at SEQ ID NO. 38057
  misc_feature (549)..(549): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttcccttgatcgtgaaagtgctagtaagacgaatgactncgctggtgatggaactacaactgcctctgttctcgctagggagatcatcaaattgggcatgttgagcattacttcaggggcaaatccagtgtccgttaagaagggcn

SEQ ID NO: 38057 - protein, 164 aa, Zea mays
  misc_feature: Ceres CLONE 1425421-F
  misc_feature (129)..(129): Xaa is any aa, unknown, or other
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLDRESASKTNDXAGDGTTTASVLAREIIKLGMLSITSGANPVSVKKG

SEQ ID NO: 38058 - DNA, 677 bp, Zea mays
  misc_feature: Ceres CLONE 1425428-F
  misc_feature: Encodes the peptide sequence at SEQ ID NO. 38059
  misc_feature (670)..(670): n is a, c, t, g, unknown, or other
caaagctggagctccccgcggtggcggccgctctagaactagtggatcccccgggctgcaggaattcgcacgagaccattacctagaacatcctaatcgaaaaaaaccaaaatcatttcatccccggaaccggacgccgaacggcagtgctgcaaaagtccggacaaagctcgcgccgcccaccgcacccgatccgcctcgcccaggcgtgctgccgtccgctcccttctcccgcgccgtcgcctccgcctacgcccgggccgacccgctggacccagcgtgcgccgctccactcggacgcgccgccgccctctcgggttgaggcggaggtgcttggggacccgcctccatggcgagcgccggcaacagcggcagcggggacgacgatgcaggagggaagctcctggcggatcgctaccagaagggcgaggtcctcggcgagggcacgtatggagtcgtcttcaaggccatcgacaccaaggtccccttaccacaccgatctcctaaagacctaaaccctcccttcctgatctgcgggcggccaccactcgagagttagagcttggctagtccgatcaatccagcttcgaccgtagacagatgcttgcggggtttagctttcggggttagagggttttgcacggcgtagctctgtgaattggggtcattngagtggt

SEQ ID NO: 38059 - protein, 69 aa, Zea mays; identical to SEQ ID NO: 12594
  misc_feature: Ceres CLONE 1425428-F
  misc_feature: SWISSPROT Homolog: EC 2.7.11.22 Cyclin-dependent kinase

SEQ ID NO: 38060 - DNA, 650 bp, Zea mays
  misc_feature: Ceres CLONE 1425434-F
aagctggagctccccgcggtggcggccgctctagaactagtggatcccccgggctgcaggaattcgcacgagaccattacctagaacatcctaatcaaaaaagatatgaacgtgtcacacttgtgtatggaaggaagaagctatttcagaaaggaaccctgaacttcttcgagatggtgctacctacacgacattactcaagggtttaggaaatatccgagacctttaatccgtatgaaatattgtggaggagaagaaatcttcactagttgcaatcaacaggactgcatacgcatgctgtgggagatgcattgctacctcgggggtccatccatggggccctttgcatttttggagatataatagagcatgctgactagagaaatgatttgagacctgaacctaatctttatctttcgatattgacagctcttgctaccataagtgatgttgatatagtcatgacatttaacacgcgcctgtggctggattcaggtggataaattagccgtgccgccaatcaacagacacatgagctattaatggaagctgccatacatgatattgccatagatttggctagagggcttcatggtacgactactgaatgagaaagaatgtttctcttggacaagtacaataactctgcc

SEQ ID NO: 38061 - DNA, 914 bp, Zea mays
  misc_feature: Ceres CLONE 1425434-R
ggtacgggccccccctcgaagtcgacggtatcgatattttttttttttttttttgtgaggaaatctccagtccactgtcactttcgctctgtgcatcagaagacatcgtacgcagcacgcagccacagcaggtcaggatcaaaaccttttttcgcatgcaccccttgtccaactggaggaccattacatgactagtttgcccggcaacacgacgcggagttgctacaagctgagcaaaaaaaacaccaaactagctgtggttgcaggcctcggcgtctggtttgggttttgctgccccggagatgcctgcgtcggggacatcatctgatcctgacgagtaatcccccgtgaagctccatagtatggccaaggggagaaaacgcccaagggtcttggagctggattgtgtagctgccttccggtcttgtttaccacttcttcacccacgaatccccatttttgggactttttttctccagggaggaggtccaaatgaccttggctcccaccggggggtttgaaaagttaggcacccccccccaaagggtgggcccccctcttaaaaccattgtaaaataaagaaagggggcccgtccacaccccctttgggtacacaaaaacttttccgcgggggtgaaaaaaaaaagggcccatatgtctttctctccccccccaaatcttttctcccaaaagagggggaaatatgctccccgccttctttttctaaaaaaaaacgccattctctaaacccttttcccccaaaatttttatagttccgccccgggggaaaattggccccaaaaattttcttttaaaaggggaaccccttttttccttttccacccccgtggatttttttcaaaaataatcttggggggaaaaaaacgtgtggggtcctttaaaaaaaagaaatc

SEQ ID NO: 38062 - DNA, 651 bp, Zea mays
  misc_feature: Ceres CLONE 1425437-F
  misc_feature: Translation starting site: 231
aagctggagctccccgcggtggcggccgctctagaactagtggatcccccgggctgcaggaattcgcacgagaccattacctagaacatcctaatcgaaaaaccctacagtgagaaccgcagagacaggcgtcttcgtacgcgcctatctccgggactcagagctttccccaattccaccccttctcccatttctcaccaccgccgccgctccccacgttgaacaacaccatgagggagtgcatctcgatccacatcggccaggctggtatccaggtcggaaacgcgtgctgggagctgtactgcctcaagcatggcattcaggctgatggccaaatgcccggtgacaagaccattgggggaggtgatgatgctttcaacaccttcttcagtgagactggcgctgggaagcacgtacccccgtgctgtttttgttgacgcttgagcccactgtcatcgatgaggtgaggactggcacctaccgccagctctaccatccagagcagctcatcagtggcaaggaggatgcagccaacaacttcgctcgaggacactacaccattggcaaggagattgttgacctgtgccttgaccgcatcatgaagcttgcagataattgcactggtctccagggcttcctcgtctgcaacgt

SEQ ID NO: 38063 - DNA, 629 bp, Zea mays
  misc_feature: Ceres CLONE 1425461-F
aagctggagctccccgcggtggcggccgctctagaactagtggatcccccgggctgcaggaattcgcacgagaccattacctagaacatcctaatcgaaaagccgctaaccccctggcaatggcctacgccaccaccaaatgacatcttgatcttaggctcacttggtcaccattcctaccaccgatgtctggtgtcttcttcagttcttccgctctcctcctgaggactaggaggtcctcctcatccgtctctgcctggctgccatccgtctccatgcgtcgaccgtagatccttgtgtgtgcttccgccaatgatatcgccttgcagctgagctcctgagccgcaatttaagccgtagtgcagaagatatccaccgcctgctgcgtcacactcgcacctccacgaaagatgctgtattggatgacttctggactgctcaagtgttcaatgatgacattaccattagccgcactgttgagctcgctgcatccatggacaatgcgagtgcttacttcactcgtgaattgataatatcacgactgcttctgatgatgatgaagctgctaccgccactgttctcgctagggagaccgtcatgttggacatgctgagcattacttcctggca

SEQ ID NO: 38064 - DNA, 664 bp, Zea mays
  misc_feature: Ceres CLONE 1425474-F
  misc_feature: Encodes the peptide sequence at SEQ ID NO. 38065
  misc_feature (427)..(427): n is a, c, t, g, unknown, or other
  misc_feature (436)..(436): n is a, c, t, g, unknown, or other
  misc_feature (445)..(445): n is a, c, t, g, unknown, or other
  misc_feature (461)..(461): n is a, c, t, g, unknown, or other
  misc_feature (536)..(536): n is a, c, t, g, unknown, or other
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcgaaaacccgagagaggatacaaaggcacccggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggaacgggtccccgccgacatccgcgcgcagggncgcgtggcncgcatgtcngaccccgggctcatcngcgacatcaagcgcgccgtcaccatcccgtcatggccagggccgcatcgggcacttcgtgaaggccagatctggnagccgtgggcgtcaactacntggacaaaaccaagtgttgacccccccgaagaaacccaccaataaaaaagaaaattccgggtccctttgtttgggttgcccgaactgggaaggcctccccagggggcg

SEQ ID NO: 38065 - protein, 137 aa, Zea mays
  misc_feature: Ceres CLONE 1425474-F
  misc_feature (92)..(92): Xaa is any aa, unknown, or other
  misc_feature (117)..(117): Xaa is any aa, unknown, or other
MASDGSGVVTVYGSNGAELLEPSKQPKSATFSVKVGLAQMLRGGVIMDVVTPEQARLAEEAGACAVMALERVPADIRAQGRVARMSDPGLIXDIKRAVTIPSWPGPHRALREGQIWXPWASTTWTKPSVDPPEETHQ

SEQ ID NO: 38066 - DNA, 704 bp, Zea mays
  misc_feature: Ceres CLONE 1425479-F
  misc_feature: Encodes the peptide sequence at SEQ ID NO. 38067
  misc_feature (339)..(339): n is a, c, t, g, unknown, or other
  misc_feature (468)..(468): n is a, c, t, g, unknown, or other
  misc_feature (555)..(555): n is a, c, t, g, unknown, or other
  misc_feature (559)..(559): n is a, c, t, g, unknown, or other
  misc_feature (603)..(603): n is a, c, t, g, unknown, or other
  misc_feature (643)..(643): n is a, c, t, g, unknown, or other
  misc_feature (655)..(655): n is a, c, t, g, unknown, or other
ctggagctccccgcggtggcggccgctctagaactagtggatcccccgggctgcaggaattcgcacgagaccattacctagaacatcctaatcgaaaaagtcgaccgccgcagaccgggagtagtcgacgcgccgtcactgaatcctcagatcacggctagccgtaatcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagnagttcgagaaagaggccgcggagatgaacaagcggtcattcaagtatgcctgggtgcttttgacagctcaggccgagcgtgagagaagtatcacaattgatattgctttgtggaaagtcgagaccaccnagtactactgcactgtcattgatgcccctggacaccgtgacttcatcaagaatatgattactggcacttccccagctgactgcgctngtcntatcattgactccactactgggtggttttgaggctgtatcctcnagggatgacagacccgccagcatgctctccttgctttcangctggaatgaancaaatgatttgctgttgccacagatggatgccaccacaccaagtactcc

SEQ ID NO: 38067 - protein, 123 aa, Zea mays
  misc_feature: Ceres CLONE 1425479-F
  misc_feature (5)..(124): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (41)..(41): Xaa is any aa, unknown, or other
  misc_feature (84)..(84): Xaa is any aa, unknown, or other
  misc_feature (113)..(113): Xaa is any aa, unknown, or other
  misc_feature (114)..(114): Xaa is any aa, unknown, or other
MGKEKTHINIVVIGHVDSGKSTTTGHLIYKLGGIDKRVIEXFEKEAAEMNKRSFKYAWVLLTAQAERERSITIDIALWKVETTXYYCTVIDAPGHRDFIKNMITGTSPADCAXXIIDSTTGWF

SEQ ID NO: 38068 - DNA, 682 bp, Zea mays
  misc_feature: Ceres CLONE 1425482-F
  misc_feature: Encodes the peptide sequence at SEQ ID NO. 38069
  misc_feature (411)..(411): n is a, c, t, g, unknown, or other
  misc_feature (426)..(426): n is a, c, t, g, unknown, or other
  misc_feature (432)..(432): n is a, c, t, g, unknown, or other
aaagctggagctccccgcggtggcggccgctctagaactagtggatcccccgggctgcaggaattcgcacgagaccattacctagaacatcctaatcgaaaaacgcacaccgcgacccagtccagagccagtacgtgcgaagcagcacgcacgctgctggtccgcgtacgcgagacgacggtcaggtcggccggtgcttttcagtttggaataatgacggcgacgacgacgacagccgccggcggcggcaaggtgcagccgcgcggcctgcccgcggcgctgtccctgctgctgctcctggtgttggcagcggggctgggcggtggcgccgaggcgcagcagacgtgcgcggggcagctgcgcgggctggccccctgcttgcgctacagcgtgccacccttgccggggcanggtccgccggcgccngggccngagtgctgctccgcgctgggggccgtgtccagggactgcgcctgcggaacgttcagcatcatcaacagcctggccgccaagtgccggcctcccgccagtcagctggcagtaatgaactgatgatacccagtgcaatgccctggggcaaagggaagggattccaaccccctaaataataaaagcccccgggtccgagccaccccggggccccattccccttttcgaagggaaggcaaaacaaaaccttggg

SEQ ID NO: 38069 - protein, 112 aa, Zea mays
  misc_feature: Ceres CLONE 1425482-F
  misc_feature (66)..(66): Xaa is any aa, unknown, or other
MTATTTTAAGGGKVQPRGLPAALSLLLLLVLAAGLGGGAEAQQTCAGQLRGLAPCLRYSVPPLPGXGPPAPGPECCSALGAVSRDCACGTFSIINSLAAKCRPPASQLAVMN

SEQ ID NO: 38070 - DNA, 680 bp, Zea mays
  misc_feature: Ceres CLONE 1425488-F
  misc_feature: Encodes the peptide sequence at SEQ ID NO. 38071
aaagctggagctccccgcggtggcggccgctctagaactagtggatcccccgggctgcaggaattcgcacgagaccattacctagaacatcctaatcgaaaagacgctcgacgcctctcctcctctcctcccccacccgtccatcgcccctccctccggtctgcgctcccacagcctcacccctgcgcccccgccgattcgcatcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagagatccttcgcgcagcagcactacgctgacctttccgacaagcctttcttccccgggttggtggagtacatcatttccggccccgtggtggcgatggtgtgggaggggaaggacgtcgtgttgactggccgtaggatcattggggccaccaggccttgggaggcagcccccggtaccattcgtggggactacgccgtggaagtcggcaggtgaacatccctttctttgtactcgatcagttgtgctttgctgcgaatgttttagtttggacactttaatagccatgctctactgttgaactctggttcagtctaaataaacgtgtgctttat

SEQ ID NO: 38071 - protein, 111 aa, Zea mays
  misc_feature: Ceres CLONE 1425488-F
  misc_feature (2)..(111): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGR

SEQ ID NO: 38072 - DNA, 691 bp, Zea mays
  misc_feature: Ceres CLONE 1425507-F
  misc_feature: Encodes the peptide sequence at SEQ ID NO. 38073
  misc_feature (275)..(275): n is a, c, t, g, unknown, or other
  misc_feature (292)..(292): n is a, c, t, g, unknown, or other
aagctggagctccccgcggtggcggccgctctagaactagtggatcccccgggctgcaggaattcgcacgagaccattacctagaacatcctaatcgaaaaactaacgccccgcccctgcctggggttttaaccctacccaaccgccgcccatggcgtccatctcggagcccgctgctagggagaagcccatcgtcgtccgggtcaagcgcaaaccttcgcaaaccgcccggacgctttctggctagagattatgagaggccggcaaagaaggcngcgaatgatttctcccngctttcatctccgaacctcctcgtcctctgccagtgtgcaagcttccgaggaaccacggttaagaaaattcctgtccagcacatcgagacagtacacccctctgaaactgtccgagatggtttacatctcttttgcgtgttgactcaaattcccagagacaaagagccagacaaaggagtgggatgacagaatccagccagaccaaaacccgagccacttccatctgctgtcagaaagaagcctgtaggaatgtggaagaaatggtcggtttgcccccattttgaaagaatctcaaaagaaaaaaaggctcatacctgggaactctttgagagaaatggccacctttaggatgctgccaaggtagatccccaatgatggaaaggctccagcaggaccac

SEQ ID NO: 38073 - protein, 158 aa, Zea mays
  misc_feature: Ceres CLONE 1425507-F
  misc_feature (97)..(97): Xaa is any aa, unknown, or other
AGAPRGGGRSRTSGSPGLQEFARDHYLEHPNRKTNAPPLPGVLTLPNRRPWRPSRSPLLGRSPSSSGSSANLRKPPGRFLARDYERPAKKAANDFSXLSSPNLLVLCQCASFRGTTVKKIPVQHIETVHPSETVRDGLHLFCVLTQIPRDKEPDKGVG

SEQ ID NO: 38074 - DNA, 592 bp, Zea mays
  misc_feature: Ceres CLONE 1425509-F
  misc_feature (375)..(375): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (485)..(485): n is a, c, t, g, unknown, or other
  misc_feature (486)..(486): n is a, c, t, g, unknown, or other
  misc_feature (502)..(502): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
aaaagctggagctccccgcggtggcggccgctctagaactagtggatcccccgggctgcaggaattcgcacgagaccattacctagaacaccctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacataccntttatcaccccttggttccaacaatacccccaggccccattttttttggggggccctccctgtggggaaaaaacaccccccgggggggggaggagaaaaaaaannnnngnngggaaaaaaaaacacncggcggggtgtgttggtgtttttttnnnnaagaaaaaggggggggggggggtttttttcccccccccaaaaaaaaaaaatattttttttt

SEQ ID NO: 38075 - DNA, 706 bp, Zea mays
  misc_feature: Ceres CLONE 1425510-F
  misc_feature: Encodes the peptide sequence at SEQ ID NO. 38076
  misc_feature (307)..(307): n is a, c, t, g, unknown, or other
  misc_feature (311)..(311): n is a, c, t, g, unknown, or other
  misc_feature (372)..(372): n is a, c, t, g, unknown, or other
  misc_feature (423)..(423): n is a, c, t, g, unknown, or other
acaagctggagctccccgcggtggcggccgctctagaactagtggatcccccgggctgcaggaattcgcacgagaccattacctagaacatcctaatcgaaaactcccttcctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccanggangtgcagttcgaggacaggctcttcactctgcaaatatgggacactgctggtcaggaaaggnttcagagtcttggcgttgcattctaccggggagcagattgttgtgcctagnccatgatgtaattctatgaaatcgttggaaaaccttcccaactggctggaaaagttctaaattcgggaagcccatcaaaccgggaattttcccttttttgtcgtgggggaaaaaatttatattaatgggggaaaacccccttgtgtgtccaaaaaaaaagaaaaaggggtggggccccctaagggaaaccccccctttttaacccccctccggggggggaaaaaccgggaaaaacccccccccgctgtttgaaaaaaaccccccaaaaaaaaaggggaaaaaa

SEQ ID NO: 38076 - protein, 85 aa, Zea mays
  misc_feature: Ceres CLONE 1425510-F
  misc_feature (10)..(86): Pfam Name: Ras Pfam Description: Ras family
  misc_feature: SWISSPROT Homolog: EC 2.7.11.1 Non-specific serine/threonine protein kinase
  misc_feature (48)..(48): Xaa is any aa, unknown, or other
  misc_feature (49)..(49): Xaa is any aa, unknown, or other
  misc_feature (70)..(70): Xaa is any aa, unknown, or other
MASRRRTLLKVIILGDSGVGKTSLMNQYVNKKFSNQYKATIGADFLTXXVQFEDRLFTLQIWDTAGQERXQSLGVAFYRGADCCA

SEQ ID NO: 38077 - DNA, 714 bp, Zea mays
  misc_feature: Ceres CLONE 1425521-F
  misc_feature: Encodes the peptide sequence at SEQ ID NO. 38078
aagctggagctccccgcggtggcggccgctctagaactagtggatcccccgggctgcaggaattcgcacgagaccattacctagaacatcctaatcgaaaaatatgagtcgttgcctcgcagtttatatccctactgtttcggactttcgggttttggccgacacccgacaatcttaacatcaaactcgtcgtccacgcctcctcggcaaggttgcgtacggcgtggccctaaggcataccagcgggatcaagctattttgctggccaaccgaacggtcaagccgacgatgacgctcggatcggcggcacacaagatcccgctggaggttgcgcacaccctcgtcgagatcgccgaggtcgcgcgctacgcctaccaccaccgccccggccgccctgcaacccacgagggggacccgactgcgccgcccgcaggggctgatagcagcgggggcaccaacgaggatgccgcgcggctgctggaggagaacgccatgctccgcgcccgactcgcagatgacctcgcgctcctgcgtgagctccacggcgcgccctgcgtctccaaggagtgccctcctgatctatacaaccgattgatggcggcggtcaacaatgttagcttccttgctcatctcgagaaatacaggatgagtcagcacgtcaacttaatgaaactacttctggcgacatgacagaggtggaagctgcagacattc

SEQ ID NO: 38078 - protein, 133 aa, Zea mays
  misc_feature: Ceres CLONE 1425521-F
MTLGSAAHKIPLEVAHTLVEIAEVARYAYHHRPGRPATHEGDPTAPPAGADSSGGTNEDAARLLEENAMLRARLADDLALLRELHGAPCVSKECPPDLYNRLMAAVNNVSFLAHLEKYRMSQHVNLMKLLLAT

SEQ ID NO: 38079 - DNA, 703 bp, Zea mays
  misc_feature: Ceres CLONE 1425535-F
  misc_feature: Encodes the peptide sequence at SEQ ID NO. 38080
  misc_feature (580)..(580): n is a, c, t, g, unknown, or other
  misc_feature (629)..(629): n is a, c, t, g, unknown, or other
aagctggagctccccgcggtggcggccgctctagaactagtggatcccccgggctgcaggaattcgcacgagaccattacctagaacatcctaatcgaaaaaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcaaggatatatagataatatacaaacaaaggttcctccagagcccagagcaggagggaagtcaccggccgtcggcggggaggagatgtcggacggcgcgggctcccggacgggcgtcgctggcgcgctgggcctctcggtcacctcgtcggtggccatcgtcatctgcaacaagtacctcatcagcactctaggcttcttcttcgcgacgacgctgacgagctggcacctcatggtgaccttcttcacgctgtacgttgcgcagcggctgcgcttcttcgagccaaagccgatcgacgcgcgcaccgtcatctccttcggcctgctncacggcatctccattggcctccctcactcctgcctcgggtttcactctngtggcttctaccagatgaccagctgggcatcatacccttcacatagtcttggaaccctctttcggagcagaagt

SEQ ID NO: 38080 - protein, 122 aa, Zea mays
  misc_feature: Ceres CLONE 1425535-F
  misc_feature (98)..(98): Xaa is any aa, unknown, or other
MSDGAGSRTGVAGALGLSVTSSVAIVICNKYLISTLGFFFATTLTSWHLMVTFFTLYVAQRLRFFEPKPIDARTVISFGLLHGISIGLPHSCLGFHSXGFYQMTSWASYPSHSLGTLFRSRS

SEQ ID NO: 38081 - DNA, 720 bp, Zea mays
  misc_feature: Ceres CLONE 1425538-F
  misc_feature: Encodes the peptide sequence at SEQ ID NO. 38082
  misc_feature (675)..(675): n is a, c, t, g, unknown, or other
  misc_feature (720)..(720): n is a, c, t, g, unknown, or other
aaagctggagctccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagctgatggctacatcagagccagtacaagagagtttggtggtgcactactcacaacctagtaggccccgggtcctccttgctgcttcaggaagtgtagccgctataaaatttgagagcctttgccgtagcttctctgagtgggcggatgtccgagctgtggccaccacgtcatccttgcacttcgttgatagatcatctctaccaagtggcatcgttctttacactgatgatgatgaatgggtcacctggaagaaatangagatgaagtcttacacatcgagctgcggaaatggcagacgttan

SEQ ID NO: 38082 - protein, 99 aa, Zea mays
  misc_feature: Ceres CLONE 1425538-F
  misc_feature: SWISSPROT Homolog: EC 4.1.1.36 Phosphopantothenoylcysteine decarboxylase
  misc_feature (85)..(85): Xaa is any aa, unknown, or other
MATSEPVQESLVVHYSQPSRPRVLLAASGSVAAIKFESLCRSFSEWADVRAVATTSSLHFVDRSSLPSGIVLYTDDDEWVTWKKXEMKSYTSSCGNGRR

SEQ ID NO: 38083 - DNA, 520 bp, Zea mays
  misc_feature: Ceres CLONE 1425539-F
  misc_feature: Encodes the peptide sequence at SEQ ID NO. 38084
  misc_feature (158)..(158): n is a, c, t, g, unknown, or other
  misc_feature (306)..(306): n is a, c, t, g, unknown, or other
  misc_feature (315)..(315): n is a, c, t, g, unknown, or other
  misc_feature (340)..(340): n is a, c, t, g, unknown, or other
  misc_feature (342)..(342): n is a, c, t, g, unknown, or other
aaagctggagctccccgcggtggcggccgctctagaactagtggatcccccgggctgcaggattcgcacgagaccattacctagaacatcctaatcgaaaaaactactccgtcactttgtttgcaaagctcctcctcgatccatcgatcactgcaccnggccggcggcaccgcgctcgcagggggctagcccaacagacgcagcatggcgacgtgacgcagcgcatctacgcggcgcacgcactacggcacacacacaggagagcggcgcccatggtgacagtgaagcatgtccaacagggcaacngctcccagnctaacggggaaacttttcccctggngnttctttgggcttcgggttggctaaagcccccgggggggtggccgggcacccgggttccgattttacccccgggggccccccccctttttttggagggcccatggggttccccctctcgggcccttggggttgggggggtgccccccaaaggggccccccaaaaagggggggggggggc

SEQ ID NO: 38084 - protein, 82 aa, Zea mays
  misc_feature: Ceres CLONE 1425539-F
  misc_feature (12)..(12): Xaa is any aa, unknown, or other
  misc_feature (15)..(15): Xaa is any aa, unknown, or other
  misc_feature (23)..(23): Xaa is any aa, unknown, or other
  misc_feature (24)..(24): Xaa is any aa, unknown, or other
MVTVKHVQQGNXSQXNGETFPLXXLWASGWLKPPGGWPGTRVPILPPGAPPLFLEGPWGSPSRALGVGGVPPKGAPQKGGGG

SEQ ID NO: 38085 - DNA, 647 bp, Zea mays
  misc_feature: Ceres CLONE 1425545-F
  misc_feature: Encodes the peptide sequence at SEQ ID NO. 38086
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaagggctagccaacgagacggcagcaatggcggaccgtgaccgcagcggcatcaacggaggcgcccacaccacctacgggcagcagcagcagcagggaggaggcgggcgccccatgggtgagcaggtgaagggcatgctccacgacaaggggccgacagcgtcgcacgcactgaccgtggtgacgctgttcccgctgggcgggctgctgctggtgctgtccgggctggcgctgacggcctccgtggtggggctggccgtggccaccccggtgttcctgatcttcacccccgtgctcgtccccgccgcgctgctcatcgggacggccgtcatggggttcctcacgtcgggcgcactggggctcgggggcctgtcctcactcacgtgcctagacaacacggcaccgacaggcgttccagcgcaccccggactacgtggaggacgcacaactcacgatggcggaggcctctacgca

SEQ ID NO: 38086 - protein, 149 aa, Zea mays
  misc_feature: Ceres CLONE 1425545-F
  misc_feature (44)..(148): Pfam Name: Oleosin Pfam Description: Oleosin
MADRDRSGINGGAHTTYGQQQQQGGGGRPMGEQVKGMLHDKGPTASHALTVVTLFPLGGLLLVLSGLALTASVVGLAVATPVFLIFTPVLVPAALLIGTAVMGFLTSGALGLGGLSSLTCLDNTAPTGVPAHPGLRGGRTTHDGGGLYA

SEQ ID NO: 38087 - DNA, 646 bp, Zea mays
  misc_feature: Ceres CLONE 1425547-F
  misc_feature: Encodes the peptide sequence at SEQ ID NO. 38088
aaagctggagctccccgcggtggcggccgctctagaactagtggatcccccgggctgcaggaattcgcacgagaccattacctagaacatcctaatcgaaaaaggagtcaggtcctcgcgccgcgcacgggccagaaacgacgagagcgcgcccatccggacccggacagagctcgcctgcgcctgcgcctccaccgatcggcaagcgggaggggagatgaggggttcgtcgcggacgccggtccccgtgatgatggcctgggtgcagcgccagccgcccaaagtcaaggccttcctcgccgtcgtcacgcggatggctgcgctcgtcttcatccgcttcatcgtccggaaccacgacaacctcttcgtcgccgccgaggccgcgcacgcgctcgggatcgccgtgctcatctacaagctcaccgaggagaagacctgcgccggattgtcactcagctctcaggatttcactgcattatttctggccactaggttgcattgtgatgctgctatgcagtatgacatccatacagtctctggataccgctgcacttgcagctactctttttgttaggtacatgattcggctcagactgatgtcaccctatacgctggacaaggacaactttgcctcgtaggatgcgaa

SEQ ID NO: 38088 - protein, 118 aa, Zea mays
  misc_feature: Ceres CLONE 1425547-F
MRGSSRTPVPVMMAWVQRQPPKVKAFLAVVTRMAALVFIRFIVRNHDNLFVAAEAAHALGIAVLIYKLTEEKTCAGLSLSSQDFTALFLATRLHCDAAMQYDIHTVSGYRCTCSYSFC

SEQ ID NO: 38089 - DNA, 653 bp, Zea mays
  misc_feature: Ceres CLONE 1425549-F
aaagctggagctccccgcggtggcggccgctctagaactagtggatcccccgggctgcaggaattcgcacgagaccattacctagaacatcctaatcgaaaaaaacgatcacacaccactccacatcagtagcaagagggatagagcaaggccgcacagacacacacaccactaggctagcctacccttttagtcgtccaggaggaccaagaagggcgcgcacccaagcaggctagctagaacagagcctatcgaccgagagctagcacgcgatggcgaggtcttccaagatgatggtggcggcagctctgctggccttggccctggccgtgtcaatcgcctaggcgaggaacatcaaaaccactaccacggagaataaggacgacgcggtggtgcagccgcagaccttcccacccttcgacacgcctcggcggaggcgcgtccccagcgttcggcggcctccccggcggcagcattcctggcagcagcattcccgggttcagcatgcccggcagcggcagcagcctacccgggttcaacttgcccggcagcggcagcatgccccctcttcggcggcggctccccgggcttcaccggcttcagcggcatgcccgggtcccccaccgccggctccgaccccgagcacgccaaca

SEQ ID NO: 38090 - DNA, 654 bp, Zea mays
  misc_feature: Ceres CLONE 1425550-F
  misc_feature: Encodes the peptide sequence at SEQ ID NO. 38091
aaagctggagctccccgcggtggcggccgctctagaactagtggatcccccgggctgcaggaattcgcacgagaccattacctagaacatcctaatcgaaaaaaaggaaggttccagcgaccgcggtcgtggagtaggactgtaggataaagcgcgatggggaagaagcggcagcttatctgcctcgcagccgccgtcggcgccgcggccatcctcctgacagcgtcggccaagaagtccagcgacgtcaccgagcttcacatcggcgtccagtacaaacctgagtcatgtatcctgcaagcacacaaaggagacaaaattaaggttcattatcgtgaggcactcactgacggatcagtttttgattcttgctatgaccgacgtgacccgtttgaatttactcttggcaatggcctggtgataaaaggctgggaccaaggattgctaggtatgtgcgtctgtgacaagctgaagctaaagatacctgcaaagatgggctatggcgagcgaggctctccaccgaagattccaggcggagcgactctggtcttcgacacggagcttatcgccgtcaacgggaagacatctggcggtgcgaatccggaaactgaaagtgagctatgatacgatgcactggatggagagtttcagctc

SEQ ID NO: 38091 - protein, 155 aa, Zea mays
  misc_feature: Ceres CLONE 1425550-F
  misc_feature (43)..(137): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGKKRQLICLAAAVGAAAILLTASAKKSSDVTELHIGVQYKPESCILQAHKGDKIKVHYREALTDGSVFDSCYDRRDPFEFTLGNGLVIKGWDQGLLGMCVCDKLKLKIPAKMGYGERGSPPKIPGGATLVFDTELIAVNGKTSGGANPETESEL

SEQ ID NO: 38092 - DNA, 659 bp, Zea mays
  misc_feature: Ceres CLONE 1425555-F
  misc_feature: Encodes the peptide sequence at SEQ ID NO. 38093
aagctggagctccccgcggtggcggccgctctagaactagtggatcccccgggctgcaggaattcgcacgagaccattacctagaacatcctaatcgaaaaatacttaccttggggctctcttctctcgacaatttcccgatctttccgccgatcaggtgactgggtacgccaccaaattctccgatgagttgatcgctaacgctatttacctcgtcacagccggaaaaggaaatcgcgcaacggatgagtcaactggaaacatgggagagcgtcttgcaagcatcagcgtctataatgttgagacccatccaatggttctatgtgagcttctcttcagcgcccctggtgctctcccttgcctcagcgtggtcatcctcttcgagtcaactctttaccaaaagagctccgatggcgagcttttcgttgacatcttgaaggaaggaggagtactcccatgtatcgaagtcgacgaaggtaccgtgcgagctactccggaccgacggccgagactgccactcatgggtcttgacagcctcggtgagcggtgctagaaatactacgaagctggtgcacgtctcgccgatgggtttgcgggttcttaagatcggtcagaacctaccatctgaactttgcatccacgagaacgctttaccggtt

SEQ ID NO: 38093 - protein, 96 aa, Zea mays
  misc_feature: Ceres CLONE 1425555-F
  misc_feature: SWISSPROT Homolog: EC 4.1.2.13 Fructose-bisphosphate aldolase
MGERLASISVYNVETHPMVLCELLFSAPGALPCLSVVILFESTLYQKSSDGELFVDILKEGGVLPCIEVDEGTVRATPDRRPRLPLMGLDSLGERC

SEQ ID NO: 38094 - DNA, 635 bp, Zea mays
  misc_feature: Ceres CLONE 1425557-F
  misc_feature: Encodes the peptide sequence at SEQ ID NO. 38095
aaagctggagctccccgcggtggcggccgctctagaactagtggatcccccgggctgcaggaattcgcacgagaccattacctagaacatcctaatcgaaaattaactactccgtcactttgtttgcagagctcctcttccatccatctatgactgcaccggtcgggtgtacctcgctcgcaagggctaggcaacaagacggcagcaatggaggaccgggacagcttcggcaacaactgcagagaccacgccacctacgggcagcagcactagctggcagaaggcccgcgcttcatgggtgagcacgggaacgccatgctccacgacaaggtgccgaccgcgtcccacgcgctgacggtggtgattctgttcccgctgggcgagcatgagctggtgctgtcggggctggccctcaccgcgtacaatggtggggatgaccgtggccacgcctgtgtatctctgatcttcagccccgtgctcgtcttcgccacgctgctcatcgagacggacgtcatgttgatcctcacctcaggcgcactggtgatctggtccccgtcctcgatcacgtgcctctccaactcagcgcgagggctgttccctctcactcggactactaggattaggcgctcagcctg

SEQ ID NO: 38095 - protein, 113 aa, Zea mays
  misc_feature: Ceres CLONE 1425557-F
MGEHGNAMLHDKVPTASHALTVVILFPLGEHELVLSGLALTAYNGGDDRGHACVSLIFSPVLVFATLLIETDVMLILTSGALVIWSPSSITCLSNSARGLFPLTRTTRIRRSA

SEQ ID NO: 38096 - DNA, 651 bp, Zea mays
  misc_feature: Ceres CLONE 1425560-F
  misc_feature: Encodes the peptide sequence at SEQ ID NO. 38097
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccaatgggtgagcaggtgaagggcatgctccacgacaaggggccgacggcgtcgcaggcgctgacggtggcgacgctgttcccgctggacgggctgctgctggagctgtcggggctggcgctgacggcctccgtggtggggctggccgtggccacgccggtgttcctgatcttcagccccgtgctggtccccgccgcgctgctcatcgggacggccgtcatggggttcatcacgtcgggcgcgctggggctcgggggcctgtcctcgctcacgtgcctcgccaacacggtgcggcaggcgttccagcgcaccccggactacgtgaaggaggcgcaccacacgatggctgaggccgcagctca

SEQ ID NO: 38097 - protein, 148 aa, Zea mays
  misc_feature: Ceres CLONE 1425560-F
  misc_feature (44)..(147): Pfam Name: Oleosin Pfam Description: Oleosin
MADRDRSGIYGGAHATYGQQQQQGGGGRPMGEQVKGMLHDKGPTASQALTVATLFPLDGLLLELSGLALTASVVGLAVATPVFLIFSPVLVPAALLIGTAVMGFITSGALGLGGLSSLTCLANTVRQAFQRTPDYVKEAHHTMAEAAA

SEQ ID NO: 38098 - DNA, 664 bp, Zea mays
  misc_feature: Ceres CLONE 1425563-F
  misc_feature: Encodes the peptide sequence at SEQ ID NO. 38099
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcggaaaagggttttaggcctgtgtaatccgatcgaccttgcgcagttgctccgatgggcaaggactcaaagccgaaagacgccaaggggaagggcaagcaggcggccggctcctctggcggcgacgacggaggcggcaagggaggcaagggcaagggcaagggcaagggcggtaagtccgctgacggactcggcacttgcacctacgtcaaagctaggcacgtattgtgtgacaagcaggggaagatcaatgaagcttataacaagttgcaagatggatggctgaataatggggacaaagttcctcctgctgagtttgctaaggtagcacaacagtattctgaatgcccatcacggaagaaaggaggagatcttggttggttcccgcctggcaagatggctggtcctttccaggaggttgctttcaacacacctgagggaactgttagcgcaccattcaagtccacgcacgggtatcactttatcctctgcgaaagaaggatgaactgatctggaaatgtcggttggtgagactgcatcatcaggttgtatgagacgcaatgcacacn

SEQ ID NO: 38099 - protein, 151 aa, Zea mays
  misc_feature: Ceres CLONE 1425563-F
  misc_feature (56)..(148): Pfam Name: Rotamase Pfam Description: PPIC-type PPIASE domain
  misc_feature: SWISSPROT Homolog: EC 5.2.1.8 Peptidylprolyl isomerase
MGKDSKPKDAKGKGKQAAGSSGGDDGGGKGGKGKGKGKGGKSADGLGTCTYVKARHVLCDKQGKINEAYNKLQDGWLNNGDKVPPAEFAKVAQQYSECPSRKKGGDLGWFPPGKMAGPFQEVAFNTPEGTVSAPFKSTHGYHFILCERRMN

SEQ ID NO: 38100 - DNA, 658 bp, Zea mays
  misc_feature: Ceres CLONE 1425576-F
  misc_feature: Encodes the peptide sequence at SEQ ID NO. 38101
ctggagctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttggtttcggcggctttggacagccagggaacataatgtccggtttctttggtggcgcaaatccctttgatgaccctttcttcacaaacccctttggtggcatgatgcaacctagtttctcaacccctttcagcggcatgatgcaacctagcttcatgaacccctttgagagcatgatgcaacctagcttgcttggatcaaaaatggttgcatcccattctgatctcaatttggaagctcaattaacacgcaccgagctagttgctgcctacccccagcaatttcttccattcaaccaactagcagcattgaactctgctgcttatttacagcagcaacag

SEQ ID NO: 38101 - protein, 132 aa, Zea mays
  misc_feature: Ceres CLONE 1425576-F
MQGGRGGRQGLFGFGDPFVGFGGFGQPGNIMSGFFGGANPFDDPFFTNPFGGMMQPSFSTPFSGMMQPSFMNPFESMMQPSLLGSKMVASHSDLNLEAQLTRTELVAAYPQQFLPFNQLAALNSAAYLQQQQ

SEQ ID NO: 38102 - DNA, 642 bp, Zea mays
  misc_feature: Ceres CLONE 1425577-F
  misc_feature: Encodes the peptide sequence at SEQ ID NO. 38103
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcactaggcatcccaatctcgcgagagccagtagcggcggcggcgcttccggcttcccttcccattggcctccgggatggcgctccacctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtgccaaggagatccctgatgattattttgtttgtttggatggagacatgattactgaggaagctctaccaacat

SEQ ID NO: 38103 - protein, 139 aa, Zea mays
  misc_feature: Ceres CLONE 1425577-F
  misc_feature: SWISSPROT Homolog: EC 1.14.19.2 Acyl-[acyl-carrier-protein] desaturase
MALHLHDVALCLSPPLAARRRSGGSFVAVASMTSAAVSTRVENKKPFAPPREVHVQVTHSMPSHKIEIFKSLDDWARDNILTHLKPVEKCWQPQDFLPDPASEGFHDEVKELRERAKEIPDDYFVCLDGDMITEEALPT

SEQ ID NO: 38104 - DNA, 673 bp, Zea mays
  misc_feature: Ceres CLONE 1425583-F
  misc_feature: Encodes the peptide sequence at SEQ ID NO. 38105
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (463)..(463): n is a, c, t, g, unknown, or other
  misc_feature (464)..(464): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (488)..(488): n is a, c, t, g, unknown, or other
  misc_feature (490)..(490): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagactagtggatcccccgggctgcaggaattcgcacgagaccattacctagaacatcctaatcgaaaaatctcgtcgctcggctcccgaccgcatcgcgatcagtcatctcctgcgtctcgttctcgccggagatcagacgcgccaccgccgggcgatggatgcctcctaccgccgcgccggtgccggaagcggttctgctccccgctccgtcgaggacatctacaaggactaccgcgcccgccgctccgccgtcctccgcgccctcacccacgacgtcgaggagttctacgcgctgtgcgatccagagaaaggagaaacctgtgccnntatacnnnggtacgcaaaccaaancntggggaaggttggcccttccccggcgggaaggaggtggccccacggaactttcccggaagccctggccctcggggaatcaaacttccccggcggaacgggattgaacccgttcggaactgggtttcgggcttttttccccctccccctccgaaaatgcgggggggtaaaaaaacccccgcccc

SEQ ID NO: 38105 - protein, 127 aa, Zea mays
  misc_feature: Ceres CLONE 1425583-F
  misc_feature (58)..(58): Xaa is any aa, unknown, or other
  misc_feature (60)..(60): Xaa is any aa, unknown, or other
  misc_feature (61)..(61): Xaa is any aa, unknown, or other
  misc_feature (66)..(66): Xaa is any aa, unknown, or other
  misc_feature (67)..(67): Xaa is any aa, unknown, or other
MDASYRRAGAGSGSAPRSVEDIYKDYRARRSAVLRALTHDVEEFYALCDPEKGETCAXIXXYANQXXGKVGPSPAGRRWPHGTFPEALALGESNFPGGTGLNPFGTGFRAFFPLPLRKCGGVKKPPP

SEQ ID NO: 38106 - DNA, 663 bp, Zea mays
  misc_feature: Ceres CLONE 1425584-F
  misc_feature: Encodes the peptide sequence at SEQ ID NO. 38107
tggagctccccgcggtggcggccgctctagaactagtggatcccccgggctgcaggaattcgcacgagaccattacctagaacatcctaatcgaaaacacctctcccacccaacaacaaaacaagcctaatggcttcctctccatctcacgccactgcgttgcctacttgccctagaaccctcgccgccgcccctctttaggattcccatgtccctggtcgccccctgacacgcccgccccggatcctgcaccggaattccgcgtggaattccgggccgaaccgcctctctgcgtgcgcctccgaccaccaaactctctcacacgcgcgcgcgcgcacgtctgaggcggttggattctccggtgggggtcccttggtctcgatttgctgctgatgggggtgccgaagcagcgctggacgccggaggaagaggccgcgctcaaggccggcgtcgccaagcacgggcccggcaagtggcgcaccatcctccgggactcggacttcagcgcgctcctgcgcctccgctccaatgttgacctcaaggacaagtggcgcaacttgagcgtcaccgcaggaggttacgggtctagagagaaggcaaggatggcgttgaagaaaggcaggcgcgtggtgcctaagcttactgctgagccaatggatgtaa

SEQ ID NO: 38107 - protein, 90 aa, Zea mays
  misc_feature: Ceres CLONE 1425584-F
  misc_feature (5)..(57): Pfam Name: Myb_DNA-binding Pfam Description: Myb-like DNA-binding domain
MGVPKQRWTPEEEAALKAGVAKHGPGKWRTILRDSDFSALLRLRSNVDLKDKWRNLSVTAGGYGSREKARMALKKGRRVVPKLTAEPMDV

SEQ ID NO: 38108 - DNA, 648 bp, Zea mays
  misc_feature: Ceres CLONE 1425590-F
  misc_feature: Encodes the peptide sequence at SEQ ID NO. 38109
aaagctggagctccccgcggtggcggccgctctagaactagtggatcccccgggctgcaggaattcgcacgagaccattacctagaacatcctaatcgaaaaactgccgcgccgccaccctctacagataaggaagaggatgagggcaggtatgtctctgcgtacgttcgagcacccgaggcacggttccctcggcttcctgtgcccaggaagcgctcctcccgtcaccgcggctaggtgaagtcattccctagggatgaccccaagaagccattgccatctcactgccttccttggctactaggctggcatgactcacattgtccgtgaggctgagaagccaggatctcaactccataagaaggaagcttgtgaggctgttaccatcattgaaacccctcctcttgtcattgttgggctcgtggcatatgtgaagactccgcgtggcctccgcacactcgactctgtttgggccctacatcttatcgaataagtgaggagaaggttctactacaactggtgctagagcaagaacaaagctttcgcaaagtatgctctcaaatatgagaatgatgctgcgcgagaggaaattcagctgcgacttgagaagatgaagagatatgcttctgttatctgcgacattgctca

SEQ ID NO: 38109 - protein, 60 aa, Zea mays
  misc_feature: Ceres CLONE 1425590-F
MTHIVREAEKPGSQLHKKEACEAVTIIETPPLVIVGLVAYVKTPRGLRTLDSVWALHLIE

SEQ ID NO: 38110 - DNA, 602 bp, Zea mays
  misc_feature: Ceres CLONE 1425597-F
  misc_feature: Encodes the peptide sequence at SEQ ID NO. 38111
  misc_feature (275)..(275): n is a, c, t, g, unknown, or other
  misc_feature (285)..(285): n is a, c, t, g, unknown, or other
aagctggagctccccgcggtggcggccgctctagaactagtggatcccccgggctgcaggaattcgcacgagaccattacctagaacatcctaatcgaaaaaacttttccacctcagtcttggatgccccccctccgccgtctagatctccccaactcctccgtcctcttgcttcctgtcgtcgacctcggtggccgccgcgagctgcgggtggttcatcgccgtcgaactgcgctctccgctccttctgcactgactgttaccggcttcctggntggtcgaccngtgcggcgcgggtcgtcagtgaagctccgactatccggattgactccgatcgacctcttctgctgtgggttttttggattttgatccgtatatccgaagaatggctatggatgatttcttggtggtaactggcaggccctggtttcctgttttgccaaatacttctgggcaccccggcggagggccttcgattaaaaaggcccccgggggtctcccgttggggggcaattttccgggggggaaaccctttgggggctcacccttttttatcccccggggtttatacagaagggttttttgggaccccttaaaagccg

SEQ ID NO: 38111 - protein, 81 aa, Zea mays
  misc_feature: Ceres CLONE 1425597-F
  misc_feature (51)..(51): Xaa is any aa, unknown, or other
MPPLRRLDLPNSSVLLLPVVDLGGRRELRVVHRRRTALSAPSALTVTGFLXGRPVRRGSSVKLRLSGLTPIDLFCCGFFGF

SEQ ID NO: 38112 - DNA, 649 bp, Zea mays
  misc_feature: Ceres CLONE 1425602-F
aagctggagctccccgcggtggcggccgctctagaactagtggatcccccgggctgcaggaattcccacaaaaccattacctaaaacatcctaatcaaaaattaacagcggctttgcatttctctccttctcaaatctctttgcctctttggctccatccagcaactttcaactaccacagatacccgaccgttgcttcccacaaaccctacccaaggaacgctatgggcgacgattgacgggggaccgacaatgcgctggtgagctgaatcactagacgtactaacacgacgaggtcttacgcaattatgatccgacccgacccggcatagtgaatgcgttcacgacagatgtcgagaaattctatcaccagtgcggtccccacacagacaacttgatcctatatggattgccaaaagagactctcgaggtcactcttccaactgaagaagtacctcctcatctaccccaacctctcctgctcataaactgtgcactggatgcaacggtccaaacacactcgctagctctagttgcaggacatacagaagtatgtgatcctgttgctgcattcctatatgaacctcgtattggaatatgattacaggcccggataaggcacttcgtcatgatgcacacacaggccatg

SEQ ID NO: 38113 - DNA, 646 bp, Zea mays
  misc_feature: Ceres CLONE 1425616-F
  misc_feature: Encodes the peptide sequence at SEQ ID NO. 38114
tggagctccccgcggtggcggccgctctagaactagtggatcccccgggctgcaggaattcgcacgagaccattacctagaacatcctaatcgaaaaatcctctcgctcgccaggagaagcagccgccgttgctgctgccgcgtccacataatgggggggttcgtgaagactcataagaccaatgcgtatttcagacgtttccaagtgaaattcaagagaaggcaggctggcaagacacactactcggccaggataaggctgattaaccaagacaaaaacaagtacaacacacccaaatacagatttgttgtgcgatttaccaacaacgacatcactgcccaaatcatatctgctactatagcgggtgatatggttcttgctactgcctactcgcatgagttgccacgatatggtcttgaagttggtctgaccaactatgcagctgcctactgcactggccttctgttggctcgacgtgtgctcaagatccgtggtttggatcaggagaacgagggcaatgttgaggccactggagaggacttctcagttgagccagctgatgagaagaggcctttccatgctctcttggatgttggccttatcaggactacaacagggaaccgtgactttggtgccctcaaggca

SEQ ID NO: 38114 - protein, 165 aa, Zea mays
  misc_feature: Ceres CLONE 1425616-F
  misc_feature (27)..(165): Pfam Name: Ribosomal_L18p Pfam Description: Ribosomal L18p/L5e family
MGGFVKTHKTNAYFRRFQVKFKRRQAGKTHYSARIRLINQDKNKYNTPKYRFVVRFTNNDITAQIISATIAGDMVLATAYSHELPRYGLEVGLTNYAAAYCTGLLLARRVLKIRGLDQENEGNVEATGEDFSVEPADEKRPFHALLDVGLIRTTTGNRDFGALKA

SEQ ID NO: 38115 - DNA, 643 bp, Zea mays
  misc_feature: Ceres CLONE 1425632-F
  misc_feature: Encodes the peptide sequence at SEQ ID NO. 38116
ctggagctccccgcggtggcggccgctctagaactagtggatcccccgggctgcaggaattcgcacgagaccattacctagaacatcctaatcgaaaaatctgtacttttgattgatcgtgtctgtctgtgcaggctcaccaagatgggggccctggtgtgggagaaggtggtgcaccgccaccagggctggcgcctcctctccagcatgtggctccacgccggcgtcatccacctggtcgtcaacatgctctgcctcctcttcatcggcatgcgcctcgaacagcaattcggatacgtgaggatcggcgcgatctacttggtctccggcgtgggcggcgccgtgctgtcatcactggtcgtccggaaccgcgtcaccgtgggggcctccggggcgctcttgggcctgctgggcgccatgctctcggagctgctcaccaactggaccatctacaccaacaaggcggcggccgtggccacgctcctgtccgtggccgccgtcaacctggtgctcggcgtcctgccccacgtcgacaacctggcccacatcggcggcttcctcgcgggcttcctactcggcttcgtcgtgctcatgcgcccgcacttgggctggatggagcgctacggactccacgccggcgcgc

SEQ ID NO: 38116 - protein, 166 aa, Zea mays
  misc_feature: Ceres CLONE 1425632-F
  misc_feature (9)..(153): Pfam Name: Rhomboid Pfam Description: Rhomboid family
  misc_feature: SWISSPROT Homolog: EC 3.4.21.105 Rhomboid protease
MGALVWEKVVHRHQGWRLLSSMWLHAGVIHLVVNMLCLLFIGMRLEQQFGYVRIGAIYLVSGVGGAVLSSLVVRNRVTVGASGALLGLLGAMLSELLTNWTIYTNKAAAVATLLSVAAVNLVLGVLPHVDNLAHIGGFLAGFLLGFVVLMRPHLGWMERYGLHAGA

SEQ ID NO: 38117 - DNA, 596 bp, Zea mays
  misc_feature: Ceres CLONE 1425634-F
  misc_feature: Encodes the peptide sequence at SEQ ID NO. 38118
  misc_feature (485)..(485): n is a, c, t, g, unknown, or other
  misc_feature (500)..(500): n is a, c, t, g, unknown, or other
ggagctccccgcggtggcggccgctctagaactagtggatcccccgggctgcaggaattcgcacgagaccattacctagaacatcctaatcgaaaagactaatagcatctgcctacctgcactggactcaaaaacatgcctgccgtaggatcctgtgatgtgtccattcgcgtgttgagtcggcggcttgtgaaggcatccgacccctccctccagccgcacgtcgtcaccttctcaaacctagatctctacccggacaacgtgcaggcctccatagtgtgcctctaccccaagctgtcaacaaagtccggcccgggcggcggcttcgacgccgtcgtctccaccttcgaggccgtcctgccgaccttgcttaaccacttctaccctctcgccggtcgcattgtcgtcaacccaagctccgggcgtcccgagctcaactgccacaaccaggggcgcggaactcgtggttggagaggtcggcctcnccctgggacagctgnattacggtctttgccaagagtccctgaaaagatcatgatgccgtaccctgaggacgtcacgctctcggggcagctgctgtcctttcgcgtgcggcg

SEQ ID NO: 38118 - protein, 153 aa, Zea mays
  misc_feature: Ceres CLONE 1425634-F
  misc_feature (117)..(117): Xaa is any aa, unknown, or other
  misc_feature (122)..(122): Xaa is any aa, unknown, or other
MPAVGSCDVSIRVLSRRLVKASDPSLQPHVVTFSNLDLYPDNVQASIVCLYPKLSTKSGPGGGFDAVVSTFEAVLPTLLNHFYPLAGRIVVNPSSGRPELNCHNQGRGTRGWRGRPXPGTAXLRSLPRVPEKIMMPYPEDVTLSGQLLSFRVR

SEQ ID NO: 38119 - DNA, 750 bp, Zea mays
  misc_feature: Ceres CLONE 1425637-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (401)..(401): n is a, c, t, g, unknown, or other
  misc_feature (404)..(404): n is a, c, t, g, unknown, or other
  misc_feature (415)..(415): n is a, c, t, g, unknown, or other
  misc_feature (418)..(418): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (432)..(432): n is a, c, t, g, unknown, or other
  misc_feature (433)..(433): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttcaaactgggactccccgcggtggcggccgctctagaactagtggatcccccgggctgcaggaattcgcacgagaccattacctagaacatcctaatcgaaaagccgtggatcgagtgcggagggggagaagcgtctatcccatgtcccgcgacggcggggaatagggcgacagctgcggcggggatcggctgcggcggctcnacnaagcggcggcngcngcnnncggtgggcnngcggcaccatgtctgcgggtagtctgtggcaagaggtccctctttcatctttcacggaagaaagttcctttccggccatccccctaacttcccctaaattccttcccaacaagggggggggccccccaaaaagggtccccgcggggtcccccctttgaaaaccggggggggaaatcctcccgaaaggggaacaccccgagggggggggggggggcttttttctcaccccccacaaaggggggggtgtttttatcacccccccccccccccccccaagaggggggggcccccccccccttttttttttttttaaaaaa

SEQ ID NO: 38120 - DNA, 646 bp, Zea mays
  misc_feature: Ceres CLONE 1425646-F
  misc_feature: Encodes the peptide sequence at SEQ ID NO. 38121
  misc_feature (569)..(569): n is a, c, t, g, unknown, or other
tggagctccccgcggtggcggccgctctagaactagtggatcccccgggctgcaggaattcgcacgagaccattacctagaacatcctaatcgaaaaagtgctcactccgtccacggtccactagttgcatcggctcccgcataaagatccacaccacttgagcagcagctagctcaagggaaggagaaggctggaagtggaaagaagtgggttcttgcttgagctgagctcttgctgcccttgaatctgttagggagtggagaacggagtatggggcgcggcaagatcgagatcaagaggatcgagaactctaccaaccggcaggtgaccttctccaagcgccgggccggactggtcaagaaggcacgggagatcggcgtgctctgcgacgccgaggtcggcgtcgtcatcttctccagcggcggcaagctctacgactactgctcgcccaggacctcgctgtccaggatcttgggagagtaccagaaccactccgggaagattctgtggggtgagaagcacaagaacctgagtgcagagatcgaccgagtcaaagaggagaacgacnacctgcagattccgctcaagcatctgaaaggcgaggacctgaactccctgccagccaaggagctgatcgctattgaa

SEQ ID NO: 38121 - protein, 125 aa, Zea mays
  misc_feature: Ceres CLONE 1425646-F
  misc_feature (9)..(59): Pfam Name: SRF-TF Pfam Description: SRF-type transcription factor (DNA-binding and dimerisation domain)
  misc_feature (71)..(125): Pfam Name: K-box Pfam Description: K-box region
  misc_feature: The sequence is a functional homolog of SEQ ID NO 729 in the 10/666,642 US patent application
  misc_feature: The sequence is a functional homolog of SEQ ID NO 42 in the 10/666,642 US patent application
  misc_feature: The sequence is a functional homolog of SEQ ID NO 6 in US patent 7279615
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature (100)..(100): Xaa is any aa, unknown, or other
MGRGKIEIKRIENSTNRQVTFSKRRAGLVKKAREIGVLCDAEVGVVIFSSGGKLYDYCSPRTSLSRILGEYQNHSGKILWGEKHKNLSAEIDRVKEENDXLQIPLKHLKGEDLNSLPAKELIAIE

SEQ ID NO: 38122 - DNA, 764 bp, Zea mays
  misc_feature: Ceres CLONE 1425655-R
attgggtacgggccccccctcgagtcgacggtatcgatattttttttttttttttttgtgaggaaatctccagtccactgtcactttcgctctgtgcatcagaagacatcgtacgcagcacgcagccacagcaggtcaggatcaaaaccttttttcgcatgcaccccttgtccaactggaggaccattacatgactagtttgcccggcaacacgacgcggagttgctacaagctgagcaaaagaaacaccaaactagctgtggttgcaggcctcggcgtctggtttgggttttgctgcccgggagatgcctgcgtcggggacatcatctgatcctgacgagtagtcgccggtgaagctccatagtatggcgagggagaaaacgcccaagggtcttgagctggatgtgtagctgccttcgtacatgttaccactcttcaccacgatcaccatctcggacttgtttctcaggaggaggtcaatgacgtgctccacggtggttgaagtaagcacgcacagaggtggccctctagacattgaaataagaggtgcgtccagcttggtacaatcctcgccggtgacaatggcaatgcatcctccccaaatcatccccaaaaagaaactgcacgctcttttcaacaaacgcatcaaaaccttcccgcaatattaaattcggccggtaaaagggtccaggattccttgaaatgggaacccatatacctcccccaactgggatcattttcaaagaaaaattctggggggaaaa

SEQ ID NO: 38123 - DNA, 624 bp, Zea mays
  misc_feature: Ceres CLONE 1425657-F
  misc_feature: Translation starting site: 204
aaagctggagctccccgcggtggcggccgctctagaactagtggatcccccgggctgcaggaattcgcacgagaccattacctagaacatcctaatcgaaaaacttcaattggcgttggccgaacaggaggagaagcgaagcaagcaggcttcgagaacaagggggagggggaggaccaagccaaagggggaactagagcaagatgggcggcgaactgctgcttgcgctcctcctcatctctgctgctgccgcccctcaagtacttggagttggcaatggagacaatcacatgagaatcatccaggaggacatcattgagacagacgacaaccatcccagtgctgggtggacaaccacacgaaatccttacttttcgaactataccattgcgcaatttaagcacatacttggagtgaaaccaccaccacagaatgcactaaccgatgttcctgtcgaaacttattcaggatcactggaacttccaaaagagtttgacgctagatctgcgtggtcacgttgcatgacaattgggacatacttgatcaacgccactgtggctcgtgttgggcttctagagctgtggagtgctacaggacgtttttgcattcactcaacatgagcat

SEQ ID NO: 38124 - DNA, 627 bp, Zea mays
  misc_feature: Ceres CLONE 1425661-F
  misc_feature: Encodes the peptide sequence at SEQ ID NO. 38125
  misc_feature (245)..(245): n is a, c, t, g, unknown, or other
  misc_feature (328)..(328): n is a, c, t, g, unknown, or other
aaagctggagctccccgcggtggcggccgctctagaactagtggatcccccgggctgcaggaattcgcacgagaccattacctagaacatcctaatcgaaaactcgttgtcttggcggctgcggcggagcacggaggcgaaggaggagcagcagcagcaggcggcgccgaggagcggcatcccactcagtgcttgcaacatggctaggggattgaagaaagcacttgagagggctcatgcgcccnagcattggatgctcgacaagcttgcccgagcttttgctccccagccatcttctgggactcacaggtccagggagtggcctccnttctgatctcatcatcaagaacaggctcaagtatgctctggacctaccgggagggtcatttcttacctgaatgcaaccccctgtacttgtttaatgcgcaaggtctggattgaacaaacctcccccggtgggtttccgggggagttcattttcctcccccaaaaaaaagggaaaaaatccccgggtgcttttttgaacccaaggggggcgttttccgtttttccccatagggggggagggagggccccctttctcctcctttcggggggggggggccctttcaattttttgtccaaaag

SEQ ID NO: 38125 - protein, 44 aa, Zea mays
  misc_feature: Ceres CLONE 1425661-F
  misc_feature (3)..(40): Pfam Name: RS4NT Pfam Description: RS4NT (NUC023) domain
  misc_feature (16)..(16): Xaa is any aa, unknown, or other
MARGLKKALERAHAPXHWMLDKLARAFAPQPSSGTHRSREWPPF

SEQ ID NO: 38126 - DNA, 634 bp, Zea mays
  misc_feature: Ceres CLONE 1425663-F
  misc_feature: Encodes the peptide sequence at SEQ ID NO. 38127
aaagctggagctccccgcggtggcggccgctctagaactagtggatcccccgggctgcaggaattcgcacgagaccattacctagaacatcctaatcgaaaaaaaaagtcaaaacccaacctttattttgtttctgccaaacacttctcttcctctctccaatggcttcctccttatccttcgtctcatcctctcacctcactctccgcactccttccctcaccctacgcaaactctctccccctagaacctccgtttcgttctccgtcaaggcccaatccgtcgcactctcccaagacgatctcaagaaactcgcggcggagaaagccgtggaggcgatcaaaccggggatggtcctcggcctcggaaccggatccaccgccgccttcgccgtctaccaaatcggaaaactcctctcctccggcgagctccacgacatcgtcggcatcccgacctcaaaacacaccgaggagcaggccagatccctagggatccccctcgtggccctagacacgcatcctcggatcgacctggccatcgacggagcggacgaggtggatccgaatctggacctggtcaaggggcgaggaggcgcgctcctgaagaagaagatggtggaggccgtggcctatag

SEQ ID NO: 38127 - protein, 157 aa, Zea mays
  misc_feature: Ceres CLONE 1425663-F
  misc_feature (93)..(157): Pfam Name: Rib_5-P_isom_A Pfam Description: Ribose 5-phosphate isomerase A (phosphoriboisomerase A)
  misc_feature: SWISSPROT Homolog: EC 5.3.1.6 Ribose-5-phosphate isomerase
MASSLSFVSSSHLTLRTPSLTLRKLSPPRTSVSFSVKAQSVALSQDDLKKLAAEKAVEAIKPGMVLGLGTGSTAAFAVYQIGKLLSSGELHDIVGIPTSKHTEEQARSLGIPLVALDTHPRIDLAIDGADEVDPNLDLVKGRGGALLKKKMVEAVAY

SEQ ID NO: 38128 - DNA, 645 bp, Zea mays
  misc_feature: Ceres CLONE 1425670-F
  misc_feature: Translation starting site: 472
aaagctggagctccccgcggtggcggccgctctagaactagtggatcccccgggctgcaggaattcgcacgagaccattacctagaacatcctaatcgaaaaatcaccacatctgggtcttcataccattacctttatctactccagagtgcacaaaaacccgatcgacaccatgagggtgttgctcgttgccctcgctctcgtggctctcggtgcaagcgccgcctccacgcataaaaccggcggctgcggctgccagccaccgccaccggttcatctaccgccgccggtgcatctgccacctccggttcacctgccacctccggtgcatctcccaccgacggtccacctgccgccgccggtccacctgccaccgacggtccatgtgccgccgccggttcatctgccgccgccaacatgttactaccctactcaaccgcctcggcctcagccttattccgaggcatattcatgggcgtgccaacagacgtatccaagcccgtgccagctgcagggaacctgcggcgttggcagcacctctatcctgggccagtgtttcaagttcctgaggcatcactgcagcccgacggcgacgccctactgctcgtctcatagccagtcgttgcggcagcagtgttgccagca

SEQ ID NO: 38129 - DNA, 651 bp, Zea mays
  misc_feature: Ceres CLONE 1425671-F
  misc_feature: Encodes the peptide sequence at SEQ ID NO. 38130
  misc_feature (574)..(574): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaaaatagttcggtgcctttttctagcggggaggaggcaggcggcgcgatctggcaccggccatcacgttccctcccgccgcttccccctccctgccctcccgttccccagatctgaagccattaaaaccagcggatctcacctcggggcgcgtccgcggcatctgggcaagcgagtggtagagccagcagccatgagatggtatgcatcggtagcctcctgagggcgctggtcctgagtgcggcggcgtctgcgggcaggcgccgggggcccaggatcctgtgtggccacgaggcggatgtacgcgtgactcctcggcacggacacggctggcgcggattccgggcagtcacgggaaggatgatgctggactcctctgactgtgcctctgctgccgccgccgcggaggcggggcaggtgcagccgcagcgccgcgcggtgggggccgtgcccctggcgcacgacggcggctacnccagcggcggatgggagagagagatggcaactgagttgtggatactncagttttagaggcaagagagctacgatgga

SEQ ID NO: 38130 - protein, 110 aa, Zea mays
  misc_feature: Ceres CLONE 1425671-F
  misc_feature (93)..(93): Xaa is any aa, unknown, or other
MVCIGSLLRALVLSAAASAGRRRGPRILCGHEADVRVTPRHGHGWRGFRAVTGRMMLDSSDCASAAAAAEAGQVQPQRRAVGAVPLAHDGGYXSGGWEREMATELWILQF

SEQ ID NO: 38131 - DNA, 648 bp, Zea mays
  misc_feature: Ceres CLONE 1425672-F
  misc_feature: Encodes the peptide sequence at SEQ ID NO. 38132
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaacatcgacaaaatttgattttcctttcgtttccttttccacccccgactattacccctcctcccactccacggagaagcgaaaccgacctttccccctcccccgcattccacctcgcggagatccagtccagccctagggtttcgccagcggcgagccaaactccacgagcgggggaagaggggaaagcacggacgactagggggcagccatgggggagcagtcgctgatctacgcgttcgtggcccgaggcacggtcatactggccgagtacacggaggtcaccgggaacttcaccaccatcgcctcccagtgcctcatgaagctccccgcaagcaacaacaagttcacctacgactgcgacggtcacactttcaattacctcgtggaagacggattcacatactgcgttgatgctgttgaatcggtggggcaacaaattcctattgctttcatggatagggttaaggaggatttcacagaaaggtatggtggtgggaaagctgctactgctgcagctaacagcctcaatcgagagtttggatcan

SEQ ID NO: 38132 - protein, 112 aa, Zea mays
  misc_feature: Ceres CLONE 1425672-F
MGEQSLIYAFVARGTVILAEYTEVTGNFTTIASQCLMKLPASNNKFTYDCDGHTFNYLVEDGFTYCVDAVESVGQQIPIAFMDRVKEDFTERYGGGKAATAAANSLNREFGS

SEQ ID NO: 38133 - DNA, 882 bp, Zea mays
  misc_feature: Ceres CLONE 1425680-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (350)..(350): n is a, c, t, g, unknown, or other
  misc_feature (361)..(361): n is a, c, t, g, unknown, or other
  misc_feature (365)..(365): n is a, c, t, g, unknown, or other
  misc_feature (369)..(369): n is a, c, t, g, unknown, or other
  misc_feature (370)..(370): n is a, c, t, g, unknown, or other
  misc_feature (377)..(377): n is a, c, t, g, unknown, or other
  misc_feature (378)..(378): n is a, c, t, g, unknown, or other
  misc_feature (385)..(385): n is a, c, t, g, unknown, or other
  misc_feature (392)..(392): n is a, c, t, g, unknown, or other
  misc_feature (396)..(396): n is a, c, t, g, unknown, or other
  misc_feature (404)..(404): n is a, c, t, g, unknown, or other
  misc_feature (405)..(405): n is a, c, t, g, unknown, or other
  misc_feature (417)..(417): n is a, c, t, g, unknown, or other
  misc_feature (418)..(418): n is a, c, t, g, unknown, or other
  misc_feature (429)..(429): n is a, c, t, g, unknown, or other
  misc_feature (431)..(431): n is a, c, t, g, unknown, or other
  misc_feature (434)..(434): n is a, c, t, g, unknown, or other
  misc_feature (435)..(435): n is a, c, t, g, unknown, or other
  misc_feature (451)..(451): n is a, c, t, g, unknown, or other
  misc_feature (613)..(613): n is a, c, t, g, unknown, or other
  misc_feature (614)..(614): n is a, c, t, g, unknown, or other
  misc_feature (624)..(624): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaagctggggngactccaccgncggntggnncggccgnnctctagnaactagntggnattccccnncgggctgcaggnnaattcgcacgnanacnncattacctagaacatncctaatcgaaaaaaacaagaagcttgcattgttcgtttgctcgatcgttgcagataatggagaacctgctcgagtatcgtagtgcccccattttgcgcactgtatcagcgaacttcagcagactcgccttcccgcaactgtacatccgacggacgggtcccnnacagcaaggnagattgtgaactgttggaagggaagaagaaggctcctagtggattccaaacggggcaaccatggagggaaccttggattggacttccccccgccaaccaatgggcccgggggttcccaaacccccttccttggtggggctttccccgtggaaaggggggtttcccaaaccccccgtttttcgggaaaaatccccaaacccgttttttttttccccggtgcccctttttgggggggccgcggggggggcctagaggggc

SEQ ID NO: 38134 - DNA, 650 bp, Zea mays
  misc_feature: Ceres CLONE 1425684-F
  misc_feature: Encodes the peptide sequence at SEQ ID NO. 38135
aaagctggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaggctctgaagtcccctttgatgggcctattcgagaagcgcagagcaaggaacttcttcatttatgtccaagattacaatgaagctgatccaaggacacatca

SEQ ID NO: 38135 - protein, 157 aa, Zea mays
  misc_feature: Ceres CLONE 1425684-F
  misc_feature (1)..(157): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRTH

SEQ ID NO: 38136 - DNA, 584 bp, Zea mays
  misc_feature: Ceres CLONE 1425687-F
  misc_feature: SWISSPROT Homolog: EC 1.1.1.37 Malate dehydrogenase
  misc_feature (213)..(213): n is a, c, t, g, unknown, or other
  misc_feature (250)..(250): n is a, c, t, g, unknown, or other
  misc_feature (275)..(275): n is a, c, t, g, unknown, or other
  misc_feature (296)..(296): n is a, c, t, g, unknown, or other
  misc_feature (335)..(335): n is a, c, t, g, unknown, or other
  misc_feature (371)..(371): n is a, c, t, g, unknown, or other
  misc_feature (474)..(474): n is a, c, t, g, unknown, or other
aaagctggagctccccgcggtggcggccgctctagaactagtggatcccccgggctgcaggaattcgcacgagaccattacctagaacatcctaatcgaaaaatcccatctgctatccttggttgccgcttcctccaaagccactccaaacccccgcttccagaaccttctcgaaactctccgcctcctcctctactcgctccgatggcgaanggaccgatgcgcgtgctcgtcactggcgccgcagggncaatggatatgctcttggtccatgnatgctaggggagtatgctggntgcaaaccagcctgttattctgccatgcttgatattccngcagcagctgaagcctttatgggggtaaaatggaantgggtgatgctgccattcccctccgaagggagccgttccacactgaattttgggaaccctgccctgccggaattggcccctccgggttggggggttccccccnaagggggggaatggaaggaaaaatttttttcctaaaagtgttttttcttaaaaaacccaaaatttttcttttagaacccaggggccccccaaaggggagggttggggggg

SEQ ID NO: 38137 - DNA, 681 bp, Zea mays
  misc_feature: Ceres CLONE 1425690-F
  misc_feature: Encodes the peptide sequence at SEQ ID NO. 38138
  misc_feature (341)..(341): n is a, c, t, g, unknown, or other
aaagctggagctccccgcggtggcggccgctctagaactagtggatcccccgggctgcaggaattcgcacgagaccattacctagaacatcctaatcgaaaagtcgcctgccttcccttccttccccagttgagttccccccgcggccccgcccccggtccccttccaccgacccaccatgtcggcgatgaggtgaggttgaggccaggtctactctccgcgaccgtcgccgacgccatcgccaacgagcagtttgctccatcttcgccatctcgcacacgaatacaatacactagttttggtagagatggaggacggcggcaaggcgccggccggcctgngcaccctgcgcgcggtgctcgccatcctccagtggtggggcttcaacgtcaccgtcatcatcatgaacaagtggatcttccagaaactggatttcaagttccctctcaccgtgtcctgcgtccacttcatctgctcttccattggagcttacattgcaatcccttgtcctccaggcgaaaccccctgattccagtttgaaacgggaagaaccgcttggaaaaaggataatttccaaaggtcctttcggccttcctgcataaaacatctggtggctggggaaaatgttcagcttgggcgcttacattccccagttttccctctcaggccaaaacaattcaa

SEQ ID NO: 38138 - protein, 73 aa, Zea mays
  misc_feature: Ceres CLONE 1425690-F
  misc_feature (12)..(12): Xaa is any aa, unknown, or other
MEDGGKAPAGLXTLRAVLAILQWWGFNVTVIIMNKWIFQKLDFKFPLTVSCVHFICSSIGAYIAIPCPPGETP

SEQ ID NO: 38139 - DNA, 637 bp, Zea mays
  misc_feature: Ceres CLONE 1425691-F
  misc_feature: Encodes the peptide sequence at SEQ ID NO. 38140
aaagctggagctccccgcggtggcggccgctctagaactagtggatcccccgggctgcaggaattcgcacgagaccattacctagaacatcctaatcgaaaaatcaccatgccttgggtcttttcaccatttgatttctctactcgggaccgcacaagaacccgatcgacaccatgagggtgttgctcattaccctcggtctactggatctcgctgctagcgcaacctccacgaatacaagcggcggctgcagctgccacccactgccgcctgttcatctaccgccgccagtgtatctgccacctcagggtgagatggcacctcaggtgcatctcccaccgccggtccagctgccgccgccggtccacctgccaccgccggtctatgtgccgccgccggttcatctgacgacgccaccatgccacaactgtacttaaccgttcccggcctcagcgtcatccccagccatacacatgctcgtgccaagaaccttatctagacccgtgcgacctgaaggcgacctgcggagttggcatcaccccgatcatgggtcagagaggatatttccagagacatccgtgcaccccgacagcaacgccctagctaatcgtctcattgccctacgttgcaggccgct

SEQ ID NO: 38140 - protein, 87 aa, Zea mays
  misc_feature: Ceres CLONE 1425691-F
MRVLLITLGLLDLAASATSTNTSGGCSCHPLPPVHLPPPVYLPPQGEMAPQVHLPPPVQLPPPVHLPPPVYVPPPVHLTTPPCHNCT

SEQ ID NO: 38141 - DNA, 681 bp, Zea mays
  misc_feature: Ceres CLONE 1425692-F
  misc_feature: Encodes the peptide sequence at SEQ ID NO. 38142
  misc_feature (488)..(488): n is a, c, t, g, unknown, or other
  misc_feature (567)..(567): n is a, c, t, g, unknown, or other
  misc_feature (568)..(568): n is a, c, t, g, unknown, or other
tggagctccccgcggtggcggccgctctagaactagtggatcccccgggctgcaggaattcgcacgagaccattacctagaacatcctaatcgaaaagccaagtttttttaactatacaatccaggaaggaagtcactgtcacttggtgagatcgatggcccgcgtcgccgccgtcctcgttgctctcctcgccctctttgccgtcccggccacggcgcaggcccctgccgcgtcacccaagcgcgccccagcccctgcgccacccaagatggcccctctcccgccgccgccgaccagggcccccatggcctccccgccctcgcctcccacgatgtcgccggcgtccgccccctccgccgacgctccagccatgagccccgccggtgcgggatttggcgacgcgatggtcccggccggagcctccgctctgagtccggccgccgcgcccgtcacggagaagagaaagccggatctgcctccgccgtcngcttcgtcgccatcgccggcgctgtggcagcccccgccgtccggttctagacttccggaagtggatctgaggagctgcnnctgccccctgagcccgctcggctgttggttgatagatgcccccctgttttgccctggtttaacaacccattggctaatttatttaatttgttgtgcccggccatttagagggc

SEQ ID NO: 38142 - protein, 103 aa, Zea mays
  misc_feature: Ceres CLONE 1425692-F
  misc_feature (66)..(66): Xaa is any aa, unknown, or other
MSPAGAGFGDAMVPAGASALSPAAAPVTEKRKPDLPPPSASSPSPALWQPPPSGSRLPEVDLRSCXCPLSPLGCWLIDAPLFCPGLTTHWLIYLICCARPFRG

SEQ ID NO: 38143 - DNA, 640 bp, Zea mays
  misc_feature: Ceres CLONE 1425693-F
  misc_feature: Encodes the peptide sequence at SEQ ID NO. 38144
aaagctggagctccccgcggtggcggccgctctagaactagtggatcccccgggctgcaggaattcgcacgagaccattacctagaacatcctaatcgaaaaataggggccatcacatccaagaagagggaagagcaccaaggaccttcggcgcccgttcaggatccgcatcttcccgagcgagttcttggttgacctcttcctcttcggaccacctccaaggctcttggtgtagcttgccactctcaccaatcaagttttcatgtctgatctcgacattcagatcccaactgccttctatcccttcgctgaggccaatgctggggactctggtgcggcagcagggtcaaaggactacgtacacatgcgcatccagcagcgtaatggtcgcaagagcctgaccaccgtccagggattgaagaaggagttcagctacagctcgatcctcaaagatctcaagaaagagttctgctgcaatggtacagtgctccaggacccagaacttggacaggtcattcagctccagcgtgatcagaggaagaacgtctcgaatttcctcgtccaggccggcattgtgaagacggagcacatcaagattcatggtttctgagcaaccgccgggtggatagcaaaccaaccc

SEQ ID NO: 38144 - protein, 115 aa, Zea mays
  misc_feature: Ceres CLONE 1425693-F
  misc_feature (27)..(108): Pfam Name: SUI1 Pfam Description: Translation initiation factor SUI1
MSDLDIQIPTAFYPFAEANAGDSGAAAGSKDYVHMRIQQRNGRKSLTTVQGLKKEFSYSSILKDLKKEFCCNGTVLQDPELGQVIQLQRDQRKNVSNFLVQAGIVKTEHIKIHGF

SEQ ID NO: 38145 - DNA, 1113 bp, Zea mays
  misc_feature: Ceres CLONE 1425706-R
  misc_feature (791)..(791): n is a, c, t, g, unknown, or other
  misc_feature (942)..(942): n is a, c, t, g, unknown, or other
tgggtacgggccccccctcgaggtcgacggtgtcgataagcttttttttttttttttttggccaaaaaaaacaattcatgaggccatggaagaagggacgggagatgaccagacgtactcataataacaggacatacagaaggagcacagacatattgagagagagagagggatttacgtgcctactaagagctaattaagtgacacgcgtagcttacggataggccggctcacgtttaataaccttggagcacttaggtagatgtcagattcaagcagcgctagaggctgaggttgaggtcaagctccccggcgtcttcagcgtagtcttcgtcattggtgcctggtgcccccgccgtctggggcgcccgcctatgacgtagtcacattttgtttccccttatccgccttcaactcatgactccattcgcctactgtcgtttactaaaaagcgtcaaaaacaaggttacaaagaaatgtactttacgccaacatcgcgggtggttcgtggttgttggttgtggttgttttgcgcgaccccgtgccggcccccactcgtttccgaccttgtacacccgagtgtagcaaaacgcttcacccaccgcggtgacgattctcacacacaacaccacgattgtcaccccctcacacttacccctacaatcaccaatctagagatagactcaaaaccactagtgggtctcacatataaacaatcaactcgaacattggtcatatcttatctataacacccgaacactagtaaaactttaacaaccagacaaatcacngttagtataatacagacgtctgtgtctgtgttgcactcctcccaacagaacgcacgacttgtcagagcacacagatatgtcagcaccacagcccccaccgcctgtggtgtctccgcgcggtcgcatgccgcctcaagcacctctctgcgtnttggactcgaccacacccacatttaggtgatgcctgtgcgacgaatacgttaatacgcttgttcgctagagttgtgcccggcgtcatctgtgtggagaccattttactgccgggtggtggtgttacttcacttcgaagcggtgtggcggaggtgatggtacatttgccatg

SEQ ID NO: 38146 - DNA, 636 bp, Zea mays
  misc_feature: Ceres CLONE 1425707-F
  misc_feature: Encodes the peptide sequence at SEQ ID NO. 38147
  misc_feature (514)..(514): n is a, c, t, g, unknown, or other
aaagctggagctccccgcggtggcggccgctctagaactagtggatcccccgggctgcaggaattcgcacgagaccattacctagaacatcctaatcgaaaaaagacgatctgcgaaacaaacactagtgcgtttgcgagagaaaccgagaaagagaagctacagagtcactgaccgaccgctatggcatcgaggcagaacacgcgtgaggcgcgcgccgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcggcggcatcctgtagagcgtgcaggagggcgccaggtccttggccagcgccgtgggccgcaccttcggtggcgccaaggacgcgaccgtggaacagacctcgcagacggcgcacaccgcgtgcgaacagctcggcgagtacagggactacaccgccgacnaggcccggggaggcaacgacagcgtctcgcgtaagacgggcgagacggcggatgccacccggaaacagctgggcgagtacaggacagcgccgtggagaggcgagggagactaggacgcggtg

SEQ ID NO: 38147 - protein, 61 aa, Zea mays
  misc_feature: Ceres CLONE 1425707-F
MASRQNTREARAEADARRAVEELARARDEHLEKAEVNARSAADEIARSRADRGAAGGGGIL

SEQ ID NO: 38148 - DNA, 677 bp, Zea mays
  misc_feature: Ceres CLONE 1425710-F
  misc_feature: Encodes the peptide sequence at SEQ ID NO. 38149
  misc_feature (453)..(453): n is a, c, t, g, unknown, or other
  misc_feature (456)..(456): n is a, c, t, g, unknown, or other
  misc_feature (465)..(465): n is a, c, t, g, unknown, or other
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaacgctcgattcggccgttttccgcatccacggtgccaggcgaccgccgccgcttccctactcacccttggccggcgacgacgagcgcccactacggcaggatgacgacgctcaggaacctcaagatcaagacgtccacgtgcaagaggatcgtgaaggagctgcgctcgtacgagaaggaggtggagaaggaggctgccaagaccgccgacatgaaggagaagggcgccgatccctacgacctcaaacagcaggagaatgttttggctgagtcaaggatgatggtcccagactgccacaaacgacttgaaactgcactggctgacttgaaagcacactggctaaactgaangantcaaatgancaagggtgccnagatcgaaaaagctgacaatacaatcgcagaaattgaagcagttgtccagcccgcataaaattaactaaaaaaaactcttggtttgctgaactggtaaccgcaatctattttccatttccaccccctggggacttattacgaattgtttgaggggccaaacctgtaccatttacaacctttcggcttgaatttagattttt

SEQ ID NO: 38149 - protein, 82 aa, Zea mays
  misc_feature: Ceres CLONE 1425710-F
  misc_feature (6)..(83): Pfam Name: TBCA Pfam Description: Tubulin binding cofactor A
MTTLRNLKIKTSTCKRIVKELRSYEKEVEKEAAKTADMKEKGADPYDLKQQENVLAESRMMVPDCHKRLETALADLKAHWLN

SEQ ID NO: 38150 - DNA, 670 bp, Zea mays
  misc_feature: Ceres CLONE 1425717-F
  misc_feature: Encodes the peptide sequence at SEQ ID NO. 38151
aaagctggagctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccggagctcaagagctacctcctggtccggttggacagatcccttcgggcgctgcgtccaccgggattcaggccaagtggtgtaacatacgatgcaagggggaagaggtgggaggcagggtttgttcggttttggggacccttttgttggtttcggcggctttggacagccagggaacataatgtccggtttctttggtgggcgcacatccctttgatgaccctttcttcacaaacccctttggtggcatgatgcaacctagtttctcagcccctttcagcggcatgatgcgacctagcttcatgagcccctttggcagcatgatgcaacctaccttgcttggatcaagtatgtttgcagcccatggcaatctctatggaggcacttttggaagccagacacctctcactcgaggcatgagcaatgccagtggtttcattcagcaagcctctgaatcgagcatgcctagagggccaattatcaaggagttgtctt

SEQ ID NO: 38151 - protein, 82 aa, Zea mays
  misc_feature: Ceres CLONE 1425717-F
MMQPSFSAPFSGMMRPSFMSPFGSMMQPTLLGSSMFAAHGNLYGGTFGSQTPLTRGMSNASGFIQQASESSMPRGPIIKELS

SEQ ID NO: 38152 - DNA, 644 bp, Zea mays
  misc_feature: Ceres CLONE 1425735-F
  misc_feature: Encodes the peptide sequence at SEQ ID NO. 38153
aaagctggagctccccgcggtggcggccgctctagaactagtggatcccccgggctgcaggaattcgcacgagaccattacctagaacatccaatcgaaaagttgcgtagccaaatcgagatctccgtctcccccgtgacgaatcccacgcccacctctccccgacccggctggccgcagcaacagcgcatcgcaccgggaggcgggagccgaagaaccaaacaggagatggcgtcggcgctgtcctccctgcgctacggcgacagcctctcggtggtgggcatctccgccgcgacggccgtgctctgcgaggccatctcctggcttctcatctaccgcaccgccacctacgactccctccgcgcctccatcgaacgccactcacgcaagctggacgccatgaagtccggctccaactcctccggcgctgcctcctcctccgcgcaggccgcgtcgtcgcgggctaagaagatggaccgcgtcgagaccagcctcaaggaccgcgcggcggggacctctcgccttgccaacttcaggtcgggggccttcttccccgccgtggtcctttcgcgtttttgggctggtcaatttccccttttagaagggccgcacggttcccaaagtttgcctttttggcccctttc

SEQ ID NO: 38153 - protein, 138 aa, Zea mays
  misc_feature: Ceres CLONE 1425735-F
  misc_feature (9)..(132): Pfam Name: DUF841 Pfam Description: Eukaryotic protein of unknown function (DUF841)
MASALSSLRYGDSLSVVGISAATAVLCEAISWLLIYRTATYDSLRASIERHSRKLDAMKSGSNSSGAASSSAQAASSRAKKMDRVETSLKDRAAGTSRLANFRSGAFFPAVVLSRFWAGQFPLLEGPHGSQSLPFWPL

SEQ ID NO: 38154 - DNA, 622 bp, Zea mays
  misc_feature: Ceres CLONE 1425747-F
  misc_feature: Encodes the peptide sequence at SEQ ID NO. 38155
ggagctccccgcggtggcggccgctctagaactagtggatcccccgggctgcaggaattcgcacgagaccattacctagaacatcctaatcgaaaaacattcctaaagtttgtgtccgcaatgatccaaagtccaccaaaccgagatcatgtggaggatcatcaatcatttgatctggaagattggcttccaataacagcatcaagaaatgcaaattggtactattcagctttccacaacgtaactgcaatggttggtgctggagttcttggccttccctacgccatgtcagagcttggatggggacctggggttgcggtgctgatcctgtcatgggtgatcacgttgtacaccctctggcaaatgattgacatgcacgagatgtttgaagggcaacggtttgataggtaccacgagctgggtcaggcagcctttggaaggaagcttggtttgtatatcatcgtgccgctacagcttcttgttgaaaccagtgcgtgcattatctatatggtgaccggaggtgaatcgttgaaaaaggttcatcaactttctgtgggagatgacaagtgcacaaagctgagaatcgaatacttcattttgatatctgcctcttcacagtttg

SEQ ID NO: 38155 - protein, 167 aa, Zea mays
  misc_feature: Ceres CLONE 1425747-F
MIQSPPNRDHVEDHQSFDLEDWLPITASRNANWYYSAFHNVTAMVGAGVLGLPYAMSELGWGPGVAVLILSWVITLYTLWQMIDMHEMFEGQRFDRYHELGQAAFGRKLGLYIIVPLQLLVETSACIIYMVTGGESLKKVHQLSVGDDKCTKLRIEYFILISASSQF

SEQ ID NO: 38156 - DNA, 664 bp, Zea mays
  misc_feature: Ceres CLONE 1425763-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (292)..(292): n is a, c, t, g, unknown, or other
  misc_feature (312)..(312): n is a, c, t, g, unknown, or other
  misc_feature (386)..(386): n is a, c, t, g, unknown, or other
  misc_feature (389)..(389): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagactagtggatcccccgggctgcaggaattcgcacgagaccattacctagaacatcctaatcgaaaaaaagaacagaaaaaaaaatataaaaggtgggcgtgcaactttcccttccttcgccgaagccgcgcgacggaaaccccaaaacccnacctcatctcttttctcggncctctacgccccctcgatcggtcggcccggtcagctatgacgccgggaaactcggcccgccggatccggcgtcntcntttcctcggaacttccaggctccctaaaaaaccttgaacctggaaaaaaaagggcattggaaatggggacaagtgagcctttggaatgggatgaacccaaaatgaactttacatggcaaaatgggacggggcccttattttggggcccccctaaaaaaccccccctagaagggccccaatcccccccccctgaaaatttttttccccaaaaaggaaaaaccccccttaaaaaaccccccccccccgttttgtaatttttctttctcaaaaaaaaa

SEQ ID NO: 38157 - DNA, 662 bp, Zea mays
  misc_feature: Ceres CLONE 1425768-F
  misc_feature: Encodes the peptide sequence at SEQ ID NO. 38158
aaagctggagctccccgcggtggcggccgctctagaactagtggatcccccgggctgcaggaattcgcacgagaccattacctagaacatcctaatcaaaaactcttcttctgacttcccgactctacctgacttcgcccgctctgagaaattcactctcaccaccaccgcgccgcctccactccccccacacccccggtctgaaacccaagcttccgcttctctcatggccgacgccaccgccgccctctcagctcggagcaaggtgcaggctttcctggaggctgcgcgcgccggctacctccaatccctcaagaacctcgtcgcggcgctcgacgaggacggcacgggcgccgcctccgtcgccgccgccgtgcgtgacgccaacaagcgcaccgccctccacttcgcggcgatcggatgtcgcaccgacgtctgtgaattcctcatcagcgagctcgggctccctgtccacccaaaggaccatgatggcgaaactccgctcatacctgcgacacgccaaggccatctggacactgtctaggatcttctccaacaatggagctgaatccttccctgcccccatgcttagaagccccgcgctacaccatgctgcaggcataggggaacacggactcctgaagcttctccgtctccaggta

SEQ ID NO: 38158 - protein, 105 aa, Zea mays
  misc_feature: Ceres CLONE 1425768-F
  misc_feature: SWISSPROT Homolog: EC 2.4.2.30 NAD(+) ADP-ribosyltransferase
MADATAALSARSKVQAFLEAARAGYLQSLKNLVAALDEDGTGAASVAAAVRDANKRTALHFAAIGCRTDVCEFLISELGLPVHPKDHDGETPLIPATRQGHLDTV

SEQ ID NO: 38159 - DNA, 657 bp, Zea mays
  misc_feature: Ceres CLONE 1425772-F
  misc_feature: Translation starting site: 174
  misc_feature: SWISSPROT Homolog: EC 1.2.1.12 Glyceraldehyde-3-phosphate dehydrogenase (phosphorylating)
  misc_feature: SWISSPROT Homolog: EC 1.2.1.13 Glyceraldehyde-3-phosphate dehydrogenase (NADP(+)) (phosphorylating)
  misc_feature (379)..(379): n is a, c, t, g, unknown, or other
  misc_feature (515)..(515): n is a, c, t, g, unknown, or other
  misc_feature (552)..(552): n is a, c, t, g, unknown, or other
  misc_feature (591)..(591): n is a, c, t, g, unknown, or other
  misc_feature (595)..(595): n is a, c, t, g, unknown, or other
  misc_feature (614)..(614): n is a, c, t, g, unknown, or other
ggagctccccgcggtggcggccgctctagaactagtggatcccccgggctgcaggaattcgcacgagaccattacctagaacatcctaatcgaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccnttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatcntcagggtggtgccaagaaggttgttatctctgccccnaagcaagatgcaccccatgttttgtgtgggtgtcatgangacnagtacacctcgggatgttnaacattgttttcccaatgctaagctgcaaccacaaactggctt

SEQ ID NO: 38160 - DNA, 676 bp, Zea mays
  misc_feature: Ceres CLONE 1425773-F
  misc_feature: Encodes the peptide sequence at SEQ ID NO. 38161
aaagctggagctccccgcggtggcggccgctctagaactagtggatcccccgggctgcaggaattcgcacgagaccattacctagaacatcctaatcgaaaaacctagaacatcttaatcgaaaattatattcttctgcctgcccttccgttcaatttcaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaatatgctggtttttgtgacgccccatcaatttgtggagggtatatgtaagaagcttgtagggaagctaacaccaggagctgaggctatctccctcatcaagggcatggaggtc

SEQ ID NO: 38161 - protein, 131 aa, Zea mays
  misc_feature: Ceres CLONE 1425773-F
  misc_feature (10)..(131): Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
MEMENGHAKYRVAVIGSGNWGSVASRLIASNTAKLPSFYDEVRMWVFEEILPTGRKLSESINEQNENCKYLPGIKLGTNVIADPDLESAVKDANMLVFVTPHQFVEGICKKLVGKLTPGAEAISLIKGMEV

SEQ ID NO: 38162 - DNA, 694 bp, Zea mays
  misc_feature: Ceres CLONE 1425780-F
  misc_feature: Encodes the peptide sequence at SEQ ID NO. 38163
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (377)..(377): n is a, c, t, g, unknown, or other
  misc_feature (413)..(413): n is a, c, t, g, unknown, or other
  misc_feature (416)..(416): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctccccacgccggtcccactgcccgcgcnnnggtcactgcccacgncggtccatgtgccgcccgcggttcatctgccgccgnccnacatgcactaccctactcaacccgcccgggctcagcctcatccccagcaaacccatgcccggtgcaaaagccgattccaggccgtggcaactggagggaacttgcgggttggcaaccccccaaatcctggcccgtgcctcaaagttctagaggtttagtggcaccccaaggggaaggccctattggttcccccaaaggcaattttttggggaaaaatttttcccacccctccggggggggggccccccccccgggcacgggaatttttgtttggcccc

SEQ ID NO: 38163 - protein, 31 aa, Zea mays
  misc_feature: Ceres CLONE 1425780-F
MPGAKADSRPWQLEGTCGLATPQILARASKF

SEQ ID NO: 38164 - DNA, 723 bp, Zea mays
  misc_feature: Ceres CLONE 1425791-F
  misc_feature: Encodes the peptide sequence at SEQ ID NO. 38165
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctccctcacgtgccctcgcaacacggcgcggcaggcgttcaacgcacccccgactacgtgaaagaagcccaccncagggatgcggaagccgcggcccaccccgggccacagaaccgcgcaggcagggcaggcccatcaggggagggcccaagaaggccgcccccggggaagtccagg

SEQ ID NO: 38165 - protein, 135 aa, Zea mays
  misc_feature: Ceres CLONE 1425791-F
  misc_feature (44)..(135): Pfam Name: Oleosin Pfam Description: Oleosin
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCPRNTARQAFNAPPTT

SEQ ID NO: 38166 - DNA, 700 bp, Zea mays
  misc_feature: Ceres CLONE 1425793-F
  misc_feature: Encodes the peptide sequence at SEQ ID NO. 38167
  misc_feature (377)..(377): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaagctaaggactggggttctcgcattgccgggtccgctgtcaccggcagttctgacataacacaccgcttcttccccagttcaagtgccacaccgctcgtcgccttcccatctcgccgcgacatgaatttctgccgccacctgctcctcgccgcggtgttcgcgctcctcctcgctgtctgcgcttctgcggcgagcaggggcgctggttccttcgacccatcccgagtggtccaactctcgtggcgccccagggcgttcctgcacaaggggttccntgtcggatgcggagtgcgaccacctcatcgcgctggccaaggacagctggaaaagtctatgggtgccgataaccantccggtaagaagtgtcaaaagtgaagtgcccacagctcccggctggttcttccaaaggaaccgggataatttttacccaaaaataaggaaagggattccggctgggaattttcttccccccaaaaaagggcgaaccccttccaaaatttccccccccccaaaggggggaaaaaattaaaccccccttaaaaaattttcttgaaaaaaaaaaaacaacccttggggggggccacccccaaccccccgg

SEQ ID NO: 38167 - protein, 84 aa, Zea mays
  misc_feature: Ceres CLONE 1425793-F
  misc_feature (52)..(52): Xaa is any aa, unknown, or other
  misc_feature (77)..(77): Xaa is any aa, unknown, or other
MNFCRHLLLAAVFALLLAVCASAASRGAGSFDPSRVVQLSWRPRAFLHKGFXVGCGVRPPHRAGQGQLEKSMGADNXSGKKCQK

SEQ ID NO: 38168 - DNA, 713 bp, Zea mays
  misc_feature: Ceres CLONE 1425794-F
  misc_feature: Encodes the peptide sequence at SEQ ID NO. 38169
  misc_feature (531)..(531): n is a, c, t, g, unknown, or other
  misc_feature (532)..(532): n is a, c, t, g, unknown, or other
ctggagctccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcaggccagtaaatagagcaacacaaaacccttcaaattaatggagacctctgcagcaaccccgacccggccnngcacacagggcggcactttccccatcgcatcgccctcgtcgtcgctgaagctgtggaggccagcggcgcagcgcaacatgcgcaatcagtggtcccatctgagcgccgcccaagagcagtggctggccgccgttgctgaacgccgtgcccacgcctccgcgctcgtcaacgtccacctctc

SEQ ID NO: 38169 - protein, 71 aa, Zea mays
  misc_feature: Ceres CLONE 1425794-F
  misc_feature (12)..(12): Xaa is any aa, unknown, or other
METSAATPTRPXTQGGTFPIASPSSSLKLWRPAAQRNMRNQWSHLSAAQEQWLAAVAERRAHASALVNVHL

SEQ ID NO: 38170 - DNA, 753 bp, Zea mays
  misc_feature: Ceres CLONE 1425807-F
  misc_feature: Translation starting site: 196
  misc_feature (341)..(341): n is a, c, t, g, unknown, or other
  misc_feature (358)..(358): n is a, c, t, g, unknown, or other
  misc_feature (361)..(361): n is a, c, t, g, unknown, or other
  misc_feature (368)..(368): n is a, c, t, g, unknown, or other
  misc_feature (371)..(371): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (398)..(398): n is a, c, t, g, unknown, or other
  misc_feature (416)..(416): n is a, c, t, g, unknown, or other
aaagctggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtgtcgntggtggcggcgccgtcntcntcccacngcncgaatggggccgacggtctcnnntccntgtttcggggaagaggcngttgttgttttaacaaaacacggccaccctctgcccaagggaatcccggcctaacccgtaaaaattattaacgtttgccgcggagggtgcaccggtaaaaaggggaactttcctgggggggaattcccctcccgggatctctccacccgggaaattttaagggggtccccttaaaaaaatggggtttaaaggggggcccccctttgaaaccaaagaaaacatctctccttaaaaaaccccccttctctcccccacaaattgggccccccccccgggggggggctaaaaattcccccccccccccataaaaaatattcgccggccccttcttttttgt

SEQ ID NO: 38171 - DNA, 636 bp, Zea mays
  misc_feature: Ceres CLONE 1425817-F
tggagctccccgcggtggcggccgctctagaactagtggatcccccgggctgcaggaattcgcacgagaccattacctagaacatcctaatcgaaaaagacaacctctcatcccaacccaaacccctcagggcctcaggcagcccgcagcccgcagcccgcagccggtcagtccttccttctcctgttcgcgtccacgatcctgccgccgccgctcgcacctccacgatcctgcccagcgccgtgcgcctccacccccgccccgtccgccgcccgcccggctggccggcggcgccaccccgggacccgcgcgcgtggagccccggcctctaccagccgcacgtcgcaaccggcgaggacgcgcgcgcctgcagctcctgcccggtcccggctggccggccgccggcactccggctgcccctcagcggctcagcccctgagcttgtctgcttgactgcttcagtgcgggtgcagcacagcggcagtgccccctgtcagtgccagccgccttagctactgcttactacgttgcattttttcccctgttttgtggactgtggtaattgactgtgtatcgagcaggcataccctgttaaaaatcctggttccactactagtcaggccatggctgcagcaa

SEQ ID NO: 38172 - DNA, 654 bp, Zea mays
  misc_feature: Ceres CLONE 1425820-F
  misc_feature: Encodes the peptide sequence at SEQ ID NO. 38173
  misc_feature (544)..(544): n is a, c, t, g, unknown, or other
  misc_feature (556)..(556): n is a, c, t, g, unknown, or other
  misc_feature (654)..(654): n is a, c, t, g, unknown, or other
atagctggagctcaccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacgacgaggtgtcgcgcatgagggaagaaagcggaanccgacagcgacngcttcatcatcctggccggattcgccgcgctcctggagtgcggggtccgccgacgcccgcccccgtcaaggaagacctgcgccacgcccttcatgggn

SEQ ID NO: 38173 - protein, 138 aa, Zea mays
  misc_feature: Ceres CLONE 1425820-F
  misc_feature (56)..(84): Pfam Name: efhand Pfam Description: EF hand
  misc_feature (102)..(102): Xaa is any aa, unknown, or other
  misc_feature (106)..(106): Xaa is any aa, unknown, or other
MGKVRSFFSRSRSGKRGSARRAGSSSPHSSAASAPPSPSPLPRRSPSSSSTTTRDETERVFRKFDANGDGQISRSELAALFEGVGHAVTDDEVSRMREESGXRQRXLHHPGRIRRAPGVRGPPTPAPVKEDLRHALHG

SEQ ID NO: 38174 - DNA, 653 bp, Zea mays
  misc_feature: Ceres CLONE 1425822-F
  misc_feature: Encodes the peptide sequence at SEQ ID NO. 38175
aaagctggagctccccgcggtggcggccgctctagaactagtggatcccccgggctgcaggaattcgcacgagaccattacctagaacatcctaatcgaaaaatcaaccatattattgagaccaacaagcaacataaaaagtggaatccagtagcaacaatagagcaacaatggagaccaggatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcatgctacctgtgatcaaccaagtagctctggcaaacctttctccctactctcagcaacaacaatttcttccattcaaccaactgtctacgctgaaccctgctgcttatttgcagcaacaactattaccatttagccagctagctactgcctactctcaacaacaacaacttcttccatttaaccaattg

SEQ ID NO: 38175 - protein, 161 aa, Zea mays
  misc_feature: Ceres CLONE 1425822-F
METRIFSLLMLLALSTCVANATIFPQCSQAPIASLFPPYLPSIIASVCENPALQPYRLQQAIAASNIPLSPLLCQQSPALSLVQSLVQTIRAQQLQQLMLPVINQVALANLSPYSQQQQFLPFNQLSTLNPAAYLQQQLLPFSQLATAYSQQQQLLPFNQL

SEQ ID NO: 38176 - DNA, 651 bp, Zea mays
  misc_feature: Ceres CLONE 1425826-F
  misc_feature: Encodes the peptide sequence at SEQ ID NO. 38177
aagctggagctccccgcggtggcggccgctctagaactagtggatcccccgggctgcaggaattcgcacgagaccattacctagaacatcctaatcgaaaaattttccactttccactctgcctccgctgccgatcgccgtccccgaccgcagcgcacgactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacagagggaagcaaagtcaaatgctagcttgacaagaaaactggactgattaaggttgatcgagtcctttactcatcagttgtataccctcgcaattatggtttcattccaaggactctttgtgaacacaatgacccaatggatgtgttggtcctgatgcaggagcctgttgttcctggttcgttcctgagagctagagcaattggccttatgctcatgattgaccagcgtgaataggatgacaagataatagcagtgtgtgctgacgatcctgaataccgtcactacaacgacatcagcgagctgtctcctca

SEQ ID NO: 38177 - protein, 65 aa, Zea mays
  misc_feature: Ceres CLONE 1425826-F
  misc_feature: SWISSPROT Homolog: EC 3.6.1.1 Inorganic diphosphatase
MSEEDKAAASAEQPKRAPKLNERILSSLSRRSVAAHPWHDLEIGPGAPAVFNVVVEITEGSKVKC

SEQ ID NO: 38178 - DNA, 649 bp, Zea mays
  misc_feature: Ceres CLONE 1425829-F
  misc_feature: Encodes the peptide sequence at SEQ ID NO. 38179
aagctggagctccccgcggtggcggccgctctagaactagtggatcccccgggctgcaggaattcgcacgagaccattacctagaacatcctaatcgaaaaaaccatattattgagaccaacaagcaacatagaaagtggagtccagtagcaacaatagagcaacaatggcgaccaagatattttcactccttaagctccttgatctttctgaatgtgttgctaacgcgacaatttaccctcaatgctcacaagctcctatagcttcccttcttcccccataccttccatcaatgatagcttcagtatgtgaaaacccagctcttcaaccctataggctccaacaagcaatcgcaacaagcaacatacctttatcacccttgtttaaacaatcgccagccctatctttggtgcagtcattggtacaaaccatcagggcacagcagctgcatcaactcgtgctaccagtgatcaaccaagtagctctggcaaacctttcaccctactctcaacaacaacaattacttccattcaaccaagtgtctacattgaaccgtgctgcttatttgcaacaacaactattaccattcagccagctagctactgcctactctcagcaacaacaacttcttccatttaaccaatgggcc

SEQ ID NO: 38179 - protein, 161 aa, Zea mays
  misc_feature: Ceres CLONE 1425829-F
MATKIFSLLKLLDLSECVANATIYPQCSQAPIASLLPPYLPSMIASVCENPALQPYRLQQAIATSNIPLSPLFKQSPALSLVQSLVQTIRAQQLHQLVLPVINQVALANLSPYSQQQQLLPFNQVSTLNRAAYLQQQLLPFSQLATAYSQQQQLLPFNQWA

SEQ ID NO: 38180 - DNA, 849 bp, Zea mays
  misc_feature: Ceres CLONE 1425832-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (488)..(488): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnccaaactggaactccccgcggtggcggccgctctagaatagtggatcccccgggctgcaggaattcgcacgagaccattacctagaacatcctaatcgaaaaattgatccctgagacccatccacaattggtagctcgttgatcccaatcaagaactcacgtcaacgcactgtctcgactggtaattagtcgtcgacgtcgtcgtctatgtccaagctgatggctgccatgctgctccgaggcgcgcgcgtcgccggggccccaaaacntcacgggtaacggcaaccctgctggaatgaaaggtctttccatggccgggtgggttctttccgcccggcccccaagaaaggaaacctggaccccccctctggtttaaagcgtcgcccaaaaaaatttccaaggaaatataaaaaaccgcccggaaaaacccggaaaaaaaataaggggaaaaattccaagaggcccccccggaaagaaagggaaaaaaagcccccccggggaacacccagggagaacctccccaaaggaaaggacgcgcggggaaaaaaaaaaaaaaggggcccaagaaaaaaggcccccccccccttgggggaaaaaaaaattttttgggattaagcgcaaaaaagggcc

SEQ ID NO: 38181 - DNA, 641 bp, Zea mays
  misc_feature: Ceres CLONE 1425838-F
  misc_feature: Encodes the peptide sequence at SEQ ID NO. 38182
  misc_feature (423)..(423): n is a, c, t, g, unknown, or other
  misc_feature (433)..(433): n is a, c, t, g, unknown, or other
  misc_feature (467)..(467): n is a, c, t, g, unknown, or other
tggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaaggagttgctgtgtttggctgcangaaccctgangagatcccgtggggggtcgttggtgctgaatatngttgtgagtctactggggttttcctgaccaggagaggctgcagctcattgaagggtggtggcaagaagttgtcatccctgctcctaacaagatgccccctgtttgtccttgtggtcaacagaaggagaacagcctgaacttaacttgcccccatggtgctgcaaaccaatgcct

SEQ ID NO: 38182 - protein, 141 aa, Zea mays
  misc_feature: Ceres CLONE 1425838-F
  misc_feature (4)..(128): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (82)..(82): Xaa is any aa, unknown, or other
  misc_feature (85)..(85): Xaa is any aa, unknown, or other
  misc_feature (97)..(97): Xaa is any aa, unknown, or other
MAKIKIGINGFGRIGRLVARVALQSDDVELVAVNDPFISTDYMTYMFKYDTVHGQWKHHEVKVKDSKTLLFGEKGVAVFGCXNPXEIPWGVVGAEYXCESTGVFLTRRGCSSLKGGGKKLSSLLLTRCPLFVLVVNRRRTA

SEQ ID NO: 38183 - DNA, 641 bp, Zea mays
  misc_feature: Ceres CLONE 1425839-F
agctggagctccccgcggtggcggccgctctataactagtggatcccccgggctgcaggaattcgcacgagaccattacctagaacatcctaatcgaaaaagacaacctctcatccaaacccaaactgctctagggctcaggcagcccgcacccaggagcccgcatgcggtcagtccttccttctcctgttcgcgtccacgatcctgccagccgccgctcacacctccacgatcctgcccagtgccgtgggcctacacgcctgacccgtcctccaaccgaccggctggccagcggctcgcccccaggacccgcgagcgtggagccccggcctctaacagccgcaagaagcaaccagagaggatcctcgcgcatgaagttgctgcctggtccctgctggacgggcacttgcactccggatgcgcctcagaggcaaaggccctgaccttgtctgaaagactgcttccatgaagatgaagcacatcgttcatgacccctgtcactgccatgctccatagcaactgcataataaggtgcatgaattcctctgtcttgtcgacagtggtgattacatgtgtaattgcaatgtatcatgatagaaactctgattacagtactacttcagttatggatgctgacatga

SEQ ID NO: 38184 - DNA, 642 bp, Zea mays
  misc_feature: Ceres CLONE 1425844-F
  misc_feature: Encodes the peptide sequence at SEQ ID NO. 38185
aaagctggagctccccgcggtggcggccgctctagaactagtggatcccccgggctgcaggaattcgcacgagaccattacctagaacatcctaatcgaaaacttaaagcacgcgacgcgccctgtgctccccgctaaatcctcgctagtcctttctccatcataaacgctattcttttttccctaaagctctcagaccgccggaagcgaacgatggcgtgcaagacgaagagcctgctgttggctctcaccgtggcggagctgctcgcggtgcagtctgactcccacggccgggaggacttctcgaccacgagcaccgaggcgacgactacaccggacatgcaaaccttcttcaagccccatgacgctgcggggcaccaggatgccctcgacgcctccatgcctgacaagccggaggatgccgcagatgcactcccggacacgacaagggccggtacggcgccctcggccacgccgacttagtccgtgtccgtggccgccggtctggcctgccgcgtggcgggcgtggacatggccggaatccatgcctccgtatcatacgaggttcgcggcgcgcggcgcgagacgaaggtgcaactcggcacctccccgagagccccgtccgggcggaccggcctgaaa

SEQ ID NO: 38185 - protein, 89 aa, Zea mays
  misc_feature: Ceres CLONE 1425844-F
MACKTKSLLLALTVAELLAVQSDSHGREDFSTTSTEATTTPDMQTFFKPHDAAGHQDALDASMPDKPEDAADALPDTTRAGTAPSATPT

SEQ ID NO: 38186 - DNA, 657 bp, Zea mays
  misc_feature: Ceres CLONE 1425851-F
  misc_feature (657)..(657): n is a, c, t, g, unknown, or other
aagctggagctccccgcggtggcggccgctctagaactagtggatcccccgggctgcaggaattcgcacgagaccattacctagaacatcctaatcgaaaaatttcctctccgattttgatttccccactcgttctggatagatcatatcactgtaccgcgtccgggggacccactatttctcggattaatctatcaataccggattaatggccgaccgagacaccaaggttgtctacagcagattacctgtttgcttatgttctcaccagcccaacgaacgatacccgcccccaatcatgtgacataggaggacgacatactattcgacaacgaaccaatggactatcacgtactgacgggctccacgctgtctccactatctaccatgctaaaggtcttctactacttggctgtcacgtcctgcaacctgtttctgggccccttcactccccatgtagctcatcttagctgccgcgctcgaccgccccactgtactcatggggaacgtatggtggagctcaacacctcaggacgataggtctccatcacatacatcgcgtgagtgcctaggcaggggcagcggcatgcttaccacacaccgcctgataagtccagcgagtactttctcagcagtacgagtctacctatcacgagn

SEQ ID NO: 38187 - DNA, 671 bp, Zea mays
  misc_feature: Ceres CLONE 1425853-F
  misc_feature: Encodes the peptide sequence at SEQ ID NO. 38188
aagctggagctcaccgcggtggcggccgctctagaactagtggatcccccgggctgcaggaattcgcacgagaccattacctagaacatcctaatcgaaaaaccaaggaaattcacaaagagatactagtccctaccaaagcatacttcctgaaacactcttgcaatccactgagtcctgtttgttgagacttgagacgcatagagctagcgtcgacaatgtcgctcgtgaggcgcagcaacgtgttcgaccccttctccatggacctctgggaccctttcgacaccatgttccgctccatcgtcccgtcggcagtctccaccaactccgagaccgccgccttcgccagcgcccgcatcgactggaaggagacgcccgaggcgcacgtgttcaaggccgacctccccggcgtcaagaaggaggaggtcaaggtcgaggtcgaggacggcaacgtgctgagcatcaccggccaaaacatcaggcaagaaagaaacagggtccactgtgtgaacccttccaaaggctggatccattctcttctgaaagcgagacccaagaacgaactttaacccggttttaaccctagaggtggggcaacaaggtcccaaagctttgcccgtgggtggctttattgttgaaaagccccatttggaagggtttcctggggttgt

SEQ ID NO: 38188 - protein, 116 aa, Zea mays
  misc_feature: Ceres CLONE 1425853-F
  misc_feature (48)..(114): Pfam Name: HSP20 Pfam Description: Hsp20/alpha crystallin family
MSLVRRSNVFDPFSMDLWDPFDTMFRSIVPSAVSTNSETAAFASARIDWKETPEAHVFKADLPGVKKEEVKVEVEDGNVLSITGQNIRQERNRVHCVNPSKGWIHSLLKARPKNEL

SEQ ID NO: 38189 - DNA, 660 bp, Zea mays
  misc_feature: Ceres CLONE 1425856-F
aagctggagctcaccgcggtggcggccgctctagaactagtggatcccccgggctgcaggaattcgcacgagaccattacctagaacatcctaatcgaaaaaataattcggctgcctttttctagcggggaggaggcaggcggcgcgaatctggaaccaggcatatggttccctcccgctctttccccctccctgtcctccctttcctcatatttgaacactttaaaatcagccgatctcttcttctggcgagtcagcagactctggttcagatagcggtacagcctttcctcatgatatgggatgcatcggtagcctcctaacggcgttggtcctgactgcggcggcgactgcggggagaaaactgagagacccggatccgagatggcaccacgcacatgtaagcatgactcctcgtccggaaatagctggagcagattctcggcatctacgctcacgatgaggctccactcctctgactgtgcctctgctgccgcagaccgcggaggcggggcaggtggacccccagcaccacacggaggtggacgtggcccatgaacgcaggagccgtagctactccagtatcgcgatggataaagagaagataggcaaacttgactttgtgggatactcaaagtttttgcaaagggagacttactc

SEQ ID NO: 38190 - DNA, 642 bp, Zea mays
  misc_feature: Ceres CLONE 1425879-F
  misc_feature: Encodes the peptide sequence at SEQ ID NO. 38191
aagctggagctccccgcggtggcggccgctctagaactagtggatcccccgggctgcaggaattcgcacgagaccattacctagaacatcctaatcgaaaaggaagcttgccgacaactgcactggtctccagggcttcctcgtcttgcaacgctgttggcggaggaacagggtctggccttggttccctcctcctggagcgtctgtctgttgactacggcaagaagtctaagcttggtttcactgagtacccatccccccaagtttcgacctcagtgggtgagccatacaacagtgtcctgtccacccactccctccttgagcacactgatgtggctatcctgctggacaacgaggccatctatgacatctgccgccgttcccttgacattgagcgcccaacctacaccaacctcaacaggcttgtgtcccaggtcatctcatccctgactgcctcactgacgatcgatggtgctcttaacgtggatgtgaatgatttccacaccagcttggtgccctacccgaggatccacttcatgctttcatcctatgctccagtcatctctgctgagaatgcctacacgagcagctgtctgtagccgagatcacccacagcgcgttcgagccatcctccatgatggc

SEQ ID NO: 38191 - protein, 198 aa, Zea mays
  misc_feature: Ceres CLONE 1425879-F
  misc_feature (4)..(157): Pfam Name: Tubulin Pfam Description: Tubulin/FtsZ family, GTPase domain
AGAPRGGGRSRTSGSPGLQEFARDHYLEHPNRKGSLPTTALVSRASSSCNAVGGGTGSGLGSLLLERLSVDYGKKSKLGFTEYPSPQVSTSVGEPYNSVLSTHSLLEHTDVAILLDNEAIYDICRRSLDIERPTYTNLNRLVSQVISSLTASLTIDGALNVDVNDFHTSLVPYPRIHFMLSSYAPVISAENAYTSSCL

SEQ ID NO: 38192 - DNA, 638 bp, Zea mays
  misc_feature: Ceres CLONE 1425883-F
  misc_feature: Encodes the peptide sequence at SEQ ID NO. 38193
aagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgttcggcaagatcgacatgcagatcaagctggtgcccaggcactccgtggcacggtcaccacctttctactgtcgtcccagggcgacgcgcacgaacgagatccaactttccagttccttggggcaacctgggggggggggagaccttaaacgtggaaaaaaagggtttcccccccgaaaaagggccccggaaaaacaatttcccccccc

SEQ ID NO: 38193 - protein, 137 aa, Zea mays
  misc_feature: Ceres CLONE 1425883-F
  misc_feature: SWISSPROT Homolog: EC 2.4.1.207 Xyloglucan:xyloglucosyl transferase
MRSFAPVFLSAVVAWLELAGTAQGGNFYQDTEMTWGDGRGKVVDGGRGLDLTLDRTSGSGFQSKSEYLFGKIDMQIKLVPRHSVARSPPFYCRPRATRTNEIQLSSSLGQPGGGGDLKRGKKGFPPRKRAPEKQFPP

SEQ ID NO: 38194 - DNA, 637 bp, Zea mays
  misc_feature: Ceres CLONE 1425884-F
  misc_feature: Encodes the peptide sequence at SEQ ID NO. 38195
  misc_feature (637)..(637): n is a, c, t, g, unknown, or other
aagctggagctccccgcggtggcggccgctctagaactagtggatcccccgggctgcaggaattcgcacgagaccattacctagaacatcctaatcggaaactccctctcctctcgtccatccgttcctcccttcccctgcttcccggctctccctcccccccatccctgcacgccccttttcatgcccgaggaggggccgtggggaccaccaccagcacctccatccgcgcgcatctcgcggtggtgctcctcctcctcctccccctgctcccggggcgggcgctctcctgttcctcctcctcctgctgctggtgccacggccgggagggcggcccggacgtggctctcatggagctcgcctgggacgggtctgcggacaccgccaacctcactaatagtgaaaatggtcggttcagttatggagttgcaagctctcccgggaaaagagcatcaatggaggacttctatgacgcaaggatagacgacgttgacggagagaaagctggaatgtttggtgtgtatgatggacatgtatgagtcagagcatctgagtacgttaagcagcatcttttcagcaatttaatcagacaccccatagtcatcacagataacaaggccgctattgctgagacttn

SEQ ID NO: 38195 - protein, 62 aa, Zea mays
  misc_feature: Ceres CLONE 1425884-F
  misc_feature: SWISSPROT Homolog: EC 3.1.3.16 Phosphoprotein phosphatase
MELAWDGSADTANLTNSENGRFSYGVASSPGKRASMEDFYDARIDDVDGEKAGMFGVYDGHV

SEQ ID NO: 38196 - DNA, 668 bp, Zea mays
  misc_feature: Ceres CLONE 1425888-F
  misc_feature: Encodes the peptide sequence at SEQ ID NO. 38197
  misc_feature (668)..(668): n is a, c, t, g, unknown, or other
ggagctcaccgcggtggcggccgctctagaactagtggatcccccgggctgcaggaattcgcacgagaccattacctagaacatcctaatcgaaaaattgattttttttccgcgcagccgatttcttttcgtctctctcgctctcgccttctcggcgcagcgcagtactacgagctagcagcaccaggaacctcttcccacacttccgcgctcctccctctgtctcgagactcgagaatggttgtgtaggcgggcgcaggagggagggaggcgagagggggagctagggtttttcgccgccgccttctgttatcctcaggctctgaaccccctcctgtccggtgcgcggcggattagactccgatggggaagtctccggcgaagtggatcaagtccgtgctcttcgggaagaagtcgtcgtccaggtccggctccaccaaggccaaagatttatcgaaaggtgcgagtaacaaaggagctgctgctgcggggaaggagcccgtgttctctgagagctccccagtgatctcggagcctgtacttgttagcgcccacaacaatgagaccgtgcgggaggtggcgaagggtgagaattccagcgtgcaagaagtgccagtgaccgatgtcagtcaagtcttggagaagcagggcagtgtggggtctgatan

SEQ ID NO: 38197 - protein, 101 aa, Zea mays
  misc_feature: Ceres CLONE 1425888-F
MGKSPAKWIKSVLFGKKSSSRSGSTKAKDLSKGASNKGAAAAGKEPVFSESSPVISEPVLVSAHNNETVREVAKGENSSVQEVPVTDVSQVLEKQGSVGSD

SEQ ID NO: 38198 - DNA, 648 bp, Zea mays
  misc_feature: Ceres CLONE 1425893-F
  misc_feature: Encodes the peptide sequence at SEQ ID NO. 38199
aaagctggagctccccgcggtggcggccgctctagaactagtggatcccccgggctgcaggaattcgcacgagaccattacctagaacatcctaatcgaaaaaagatccaccaccccaccaaccaactactctcgaagtctcacctcccgctcctggcccctccctctcgttctcttcctaaatggcggccgagtccgccaggccgccctcgccgccgcgcgactccggctgccccgcgggcgcgggagactccaccagctcccagctgaccgcgaactacctcggcgtcagcttcgcgctcttcctcgccacgctcccgtcgggcaccgcggcgcgccacgtggcctcgctccaatcacggggccgcctcctcgcctcgcgcctgctggccaccgaggaccacctgcagcagctgcgcgcgcgccgccgcaaggacgcccgctccaactcccgcgccggcgagatcttcgagggccatcacgcctcctggatagaggccgagcgccgactgcaggcacgcgccaccgccgcacgaggaaaggacgcctccctccgcgcgcacctcgccgacgccaaggccgacgccgctgctctgcgcacccgcgccgagcgactctagcgcgaggccgccgagctagatgagctgc

SEQ ID NO: 38199 - protein, 145 aa, Zea mays
  misc_feature: Ceres CLONE 1425893-F
MAAESARPPSPPRDSGCPAGAGDSTSSQLTANYLGVSFALFLATLPSGTAARHVASLQSRGRLLASRLLATEDHLQQLRARRRKDARSNSRAGEIFEGHHASWIEAERRLQARATAARGKDASLRAHLADAKADAAALRTRAERL

SEQ ID NO: 38200 - DNA, 646 bp, Zea mays
  misc_feature: Ceres CLONE 1425897-F
tggagctccaccgcggtggcggccgctctagaactagtggatcccccgggctgcaggaattcgcacgagaccattacctagaacatcctaatcgaaaaagaaattcgtaactagagaaccgtaactccggtttgatccattcgaattgcgttggattcataataatatcgtctgtacagtatgacactaacatatatcacaccccatacttttattattagaaatttgtctagcctatgtttaatagattaacccctctaattgaagttaacctctccataattatagtttgattaaaatatgatttctagttaagttataattaagattaaagttgaattaattattaatggaatattctctcatatggtgcatactaatcaatttataatatagtttaatcacatagatcttccataaatcataactccttaaccatgactccgatcttactagttctcgaacccacgatctcgtagcgacgagtagatcattattatgcaatttgttcttatgtttggtgtgatgttaattattcctataccatgtttgtttgtattgctatgactagtagtgaggtcacgagaatctaaagatcatcttgatacctggaatctcaagtcccaagaaaagtatgcccttgatc

SEQ ID NO: 38201 - DNA, 616 bp, Zea mays
  misc_feature: Ceres CLONE 1425905-F
  misc_feature: Encodes the peptide sequence at SEQ ID NO. 38202
aagctggagctccccgcggtggcggccgctctagaactagtggatcccccgggctgcaggaattcgcacgagaccattacctagaacatcctaatcgaaaaagaaagcagagagagccggcaacatcgcagagagagagagagagagagagaggcaaactggagaggccgagggtgatggtttccaaggagcagaataagcgaggagctttgcatgagaagctcaagattctccgcagcgttactcactctcatgcgatcagtcgtgctgtgtgtgctctgctatatatctacgtaccaataccattcagcttttcagaccattcctatgctgtcaagttatatgcaacacgcgtacgtgtgtgtgtgtcacgcatgcagggggataaagtgtcgataatagcggacgcgtcatcgtacatcaaggaactaaagcagaagatcgcgaagctaagccaagagatggcatcgtcgtctccgcagcacgccactagtgtctgccaacaacaaccgtcgtcgtcgtcggtgagtgtgggagtcctgctggacaagaagggccgtttcctcgtcagtgtgttcatggacgagagctgcggcccgccgccggccgggctact

SEQ ID NO: 38202 - protein, 146 aa, Zea mays
  misc_feature: Ceres CLONE 1425905-F
MVSKEQNKRGALHEKLKILRSVTHSHAISRAVCALLYIYVPIPFSFSDHSYAVKLYATRVRVCVSRMQGDKVSIIADASSYIKELKQKIAKLSQEMASSSPQHATSVCQQQPSSSSVSVGVLLDKKGRFLVSVFMDESCGPPPAGL

SEQ ID NO: 38203 - DNA, 657 bp, Zea mays
  misc_feature: Ceres CLONE 1425906-F
  misc_feature: Encodes the peptide sequence at SEQ ID NO. 38204
aaagctggagctccccgcggtggcggccgctctagaactagtggatcccccgggctgcaggaattcgcacgagaccattacctagaacatcctaatcgaaaaaccaaaagttcaaaaccccatccaattccaaatcccacttctcgccagttcacctccgcctccgctcctcccctccccctcccgtcctgccatggccaccgcagcacgcgccctcgtcgccgcacgcccggcacggccgctgctgacgtctcggcgcctcccgtcctcctcttccatccgtcccgcgcggcaacgtgctggcgtcgggtgcgtccgctgcatggctcagcggccggattccacctattccccgctgcgttcgggccagggcggtgaccgtgcaccgactgaaatggcgcctctgttccctggatgcgactacaagcactggctcatcgtcatggacaagcccggcggcgagggcgccaccaagcagcacatgatagattgttacatccagacccttgcccaggtggtagggagtgaagaggaggcgaagaagaggatatataatgtgtcctgcgagcgctattttggattcagatgcgaaattgacgaggagacctccaacaaactcgaaagccttccaggggttctttttgtgcttcctgactc

SEQ ID NO: 38204 - protein, 154 aa, Zea mays
  misc_feature: Ceres CLONE 1425906-F
MATAARALVAARPARPLLTSRRLPSSSSIRPARQRAGVGCVRCMAQRPDSTYSPLRSGQGGDRAPTEMAPLFPGCDYKHWLIVMDKPGGEGATKQHMIDCYIQTLAQVVGSEEEAKKRIYNVSCERYFGFRCEIDEETSNKLESLPGVLFVLPD

SEQ ID NO: 38205 - DNA, 676 bp, Zea mays
  misc_feature: Ceres CLONE 1425915-F
  misc_feature: SWISSPROT Homolog: EC 4.1.1.33 Diphosphomevalonate decarboxylase
  misc_feature (676)..(676): n is a, c, t, g, unknown, or other
aagctggagctccccgcggtggcggccgctctagaactagtggatcccccgggctgcaggaattcgcacgagaccattacctagaacatcctaatcgaaaagaacaaacatgatccgtttccttatccccttggagcagaggaggagcagcatagcataacccgggagctcgctctcgctcccacctccccctccctccccttttgaccctccctcaccagctgcaaaaccgcgggccgcatcccgcccgcgccgcccaccggcggccacagccgcctacataaaccactaatcgaccactcgctcggggtcgagcgttacgcggctgctgtcgttgatggggaggatgagcgcctcgtcccggctcccccagaacttgatcaccgcaatgttggtcggcgtccgccccgtttgccatgagcacccactgcccctccgccgccgccattggatctctcgcttcgcgctgctctatgcccgataattccttgcaaagggaagttagtaggcataatccctactactctataagcacggtgtgtaggcgtgcacaccgtgcgccatcgttctgccagcctcccgatgctcccctgccaggatccggtcacacttttgtcgccgcaatcatcggctacctgcccctcaacatcctccccctccgctccccgtcaggatn

SEQ ID NO: 38206 - DNA, 641 bp, Zea mays
  misc_feature: Ceres CLONE 1425924-F
  misc_feature: Encodes the peptide sequence at SEQ ID NO. 38207
ctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatgccatgaaccggcgagcccccctcggcgatattgg

SEQ ID NO: 38207 - protein, 49 aa, Zea mays
  misc_feature: Ceres CLONE 1425924-F
MPTRNHNAAAAAAPQHHHHNRGGAPALGKSKAVPGRADAMNRRAPLGDI

SEQ ID NO: 38208 - DNA, 632 bp, Zea mays
  misc_feature: Ceres CLONE 1425927-F
  misc_feature (632)..(632): n is a, c, t, g, unknown, or other
aagctggagctccccgcggtggcggccgctctagaactagtggatcccccgggctgcaggaattcgcacgagaccattacctagaacatcctaatcgaaaagcaacccccgcctgcagcacgcgtcacgccacgccacctctccccagggtccggcgatgtcggcgccctccgacgccgcggtggcagccgcagcgcccgcatccacgaccaccgccgccgcctccagcggtgggctcaccttcaagctccacccgctcgtcatcgtgaacgtctccgaccaccacacccgcgtcaaggcccaggccgcctgctccggggacagctcttccccctcctcgtccgccccgggggccgggcagccgccgagggtgttcgggtgcgtgatcggggtgcagcttcctgatctgcttcgtgctcaactactttacggggaagcggcaaaacgagaacatcgcgctggcctgggccaccaagttcgccacgagggactccatcttcgacaagaacttcagccttcttggcacaggcgacggcaaggacacgccactcctgctcaaggaagggcaggacgtgttcaaattctacgccagtgggagacgcttctgccagggcatgctcgccaccatggan

SEQ ID NO: 38209 - DNA, 456 bp, Zea mays
  misc_feature: Ceres CLONE 1425929-F
  misc_feature (1)..(1): n is a, c, t, g, unknown, or other
  misc_feature (95)..(95): n is a, c, t, g, unknown, or other
  misc_feature (180)..(180): n is a, c, t, g, unknown, or other
  misc_feature (250)..(250): n is a, c, t, g, unknown, or other
  misc_feature (264)..(264): n is a, c, t, g, unknown, or other
  misc_feature (393)..(393): n is a, c, t, g, unknown, or other
  misc_feature (421)..(421): n is a, c, t, g, unknown, or other
  misc_feature (425)..(425): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
naaagctggagctccccgcggtggcggccgctctagaactagtggatcccccgggctgcaggaattcgcacgagaccattacctagaacatcctnaatcgaaaagttcaaaacgaaaagtctgatctgaagccagcagaacgtgaaaccgacagcacgtacgtacgtacgtgtgaggggnctgctcggcggccatgggagaatggtgctttcagaaacgcgcagctcttgggtgattattgtggccattnatagctcgctgcanctgctcctgaaaacctgctcaagaagctgtggagagagaaaaaaccccgaaggggtgggccacaaaaatccccccccggaagtggggtcttgtggggggggggccccctttttttttccccaaaaaagntccataaagggtgtccccccaagagggncgcncccccnnnttgtgggggggggtgnnnnggga

SEQ ID NO: 38210 - DNA, 661 bp, Zea mays
  misc_feature: Ceres CLONE 1425931-F
  misc_feature: Encodes the peptide sequence at SEQ ID NO. 38211
aaagctggagctccccgcggtggcggccgctctagaactagtggatcccccgggctgcaggaattcgcacgagaccattacctagaacatcctaatcgaaaactttcctttccctacggcggcggcgctggagcagctaagcagcagcaagatgttcgacggcttcaatctccgcttccgccgccagagcgccacccttggctgcgccatgactttctccatctacctgcccccgtccccggtgtccaaccttcccgtgttgtactggctctcgggtctcacctgcaccgaggataatttcatcataaagtccggcgcccagcacgccgccgctgcccacggcatcgccctcgtggcacctgacacctccccacttatcttctgcatgatggattcatttgatggaactattttaggcctctgattgcggaatacagatcgatttgcttgtcacaaggataaagcagatccacgatgagtagaagcgtgggcatccaaatgaataaccaggggagagcagtctaaggcaaatttgctaggctggagcagtcacaagagctagggactacagtcataggtcctgctagccagggtggagcagtcataagacctcctagcagtccaaggcaaatttgctaggtgggatggaacttggtgccac

SEQ ID NO: 38211 - protein, 90 aa, Zea mays; identical to SEQ ID NO: 18079
  misc_feature: Ceres CLONE 1425931-F
  misc_feature: SWISSPROT Homolog: EC 3.1.2.12 S-formylglutathione hydrolase

SEQ ID NO: 38212 - DNA, 667 bp, Zea mays
  misc_feature: Ceres CLONE 1425933-F
  misc_feature: Encodes the peptide sequence at SEQ ID NO. 38213
ctggagctccccgcggtggcggccgctctagaactagtggatcccccgggctgcaggaattcgcacgagaccattacctagaacatcctaatcgaaaacccacctaccgttgccgccgccacctcgccctcgcgccccctctccctcggctacgggcatcggccgccgtcatgtcaacggcggcggaacagacgatcgctgaccagaagcgcacgctgcgcgccgaggtgcgcagggcgctgaaggccctctctgccgaccagcgcgccagcgaagatctggctattcaaactacaatactggattcctcttggttcaaagcaagcaaacggttgtgcgcttatataagctgtcagcagttgcgagaagtcgatacatcaaaaatactagcagagtgtctaccgtcaaatcctggtgagtccatctgtagctgtgctcgttacagattcttccgctaacaattaggttttccttaaggacaagaggaactagcaaaggatctttatgttcctcgagtggaggataagaaccgtaatatgaggatgctcaaaatcaccaccatggatgatttagttaagaattcaatgaacattctggaaccatcgcttgtggatgctaccgggaacaatcgtgaagatgtattgtcatcatcgtccccctgttgatc

SEQ ID NO: 38213 - protein, 151 aa, Zea mays
  misc_feature: Ceres CLONE 1425933-F
  misc_feature: SWISSPROT Homolog: EC 6.3.3.2 5-formyltetrahydrofolate cyclo-ligase
GAPRGGGRSRTSGSPGLQEFARDHYLEHPNRKPTYRCRRHLALAPPLPRLRASAAVMSTAAEQTIADQKRTLRAEVRRALKALSADQRASEDLAIQTTILDSSWFKASKRLCAYISCQQLREVDTSKILAECLPSNPGESICSCARYRFFR

SEQ ID NO: 38214 - DNA, 787 bp, Zea mays
  misc_feature: Ceres CLONE 1425941-F
  misc_feature: Translation starting site: 287
  misc_feature (1)..(1): n is a, c, t, g, unknown, or other
  misc_feature (2)..(2): n is a, c, t, g, unknown, or other
  misc_feature (21)..(21): n is a, c, t, g, unknown, or other
  misc_feature (22)..(22): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (575)..(575): n is a, c, t, g, unknown, or other
  misc_feature (579)..(579): n is a, c, t, g, unknown, or other
  misc_feature (584)..(584): n is a, c, t, g, unknown, or other
  misc_feature (631)..(631): n is a, c, t, g, unknown, or other
nnccaaaacccacccaccccnntgggaggggggggaatatgtgnnnnnggcaagctggagctcaccgcggtggcggccgctctagaactggtggatcccccgggctgcaggaattcgcacgagaccattacctagaacatcctaatcgaaaaccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccccccgcgggggtccatcatcccccgaggtcgacctgtaccgcttcgacccctgggaccggccggagcgcgccctcttcggcccgccgcaggggggacttccttcaggccgcggggacccgcaagtaccccaacggggccgcgggcccaanccgnggccncccggggtcgggctacctgggaagggccacggggcgccgaacagggncccgggaaagaagggggggcccgaaagggccggggaacaaagaaaggcggctcggggggccacccccgggcaacccccccccgcggggggcccggaaagggagtgggattctgggcacaaataacccgccttgggccggggaaaccaaaaaaaaaa

SEQ ID NO: 38215 - DNA, 596 bp, Zea mays
  misc_feature: Ceres CLONE 1425942-F
  misc_feature: Translation starting site: 301
  misc_feature (215)..(215): n is a, c, t, g, unknown, or other
  misc_feature (217)..(217): n is a, c, t, g, unknown, or other
  misc_feature (218)..(218): n is a, c, t, g, unknown, or other
  misc_feature (266)..(266): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (357)..(357): n is a, c, t, g, unknown, or other
  misc_feature (361)..(361): n is a, c, t, g, unknown, or other
  misc_feature (362)..(362): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (376)..(376): n is a, c, t, g, unknown, or other
  misc_feature (386)..(386): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (437)..(437): n is a, c, t, g, unknown, or other
  misc_feature (440)..(440): n is a, c, t, g, unknown, or other
  misc_feature (441)..(441): n is a, c, t, g, unknown, or other
  misc_feature (443)..(443): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (476)..(476): n is a, c, t, g, unknown, or other
  misc_feature (479)..(479): n is a, c, t, g, unknown, or other
  misc_feature (482)..(482): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (502)..(502): n is a, c, t, g, unknown, or other
  misc_feature (504)..(504): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (522)..(522): n is a, c, t, g, unknown, or other
  misc_feature (523)..(523): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (570)..(570): n is a, c, t, g, unknown, or other
  misc_feature (577)..(577): n is a, c, t, g, unknown, or other
  misc_feature (578)..(578): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaaaaccacaggcaataaacactaaacagctcccactcccagtaaatttctcgtctcccaatctccgattcgaggaagccggaggaggggatttcgagccgcggaatcgggacatntnnagagtggccctcacccggcgctggaattgccgagagggactgggttgngagtggagttcgggaggtgtgagagaaggcggcgatggggcggctgttcctgatgcacctggacggcaacgtctaccagccttgnnnnccnaaanngnnnccnnnnnncncccccccccnttgggggggggcgcccccccccccccccccnnnccnnnnnnnnnnnnnngnggnngngggggggggggggggggnnnnnngggggcgggnggnggngnnnggggnnnnnnnnnngngnggggnnnnccnnnncccnncccnnnnnnnggnnnnnccggccnnnnnccccgcccccccccccccnccccccnnccnnnccccncccccccc

SEQ ID NO: 38216 - DNA, 668 bp, Zea mays
  misc_feature: Ceres CLONE 1425947-F
  misc_feature: Encodes the peptide sequence at SEQ ID NO. 38217
  misc_feature (599)..(599): n is a, c, t, g, unknown, or other
aagctggagctccccgcggtggcggccgctctagaactagtggatcccccgggctgcaggaattcgcacgagaccattacctagaacatcctaatcgaaaaaaagcattaacctttcagaggtaaaagctctcgaacaaagagggtgtaccggcgccaccgccagcacacaccagctcgccggagatcacaagaagatacaggaccgtgctcctcgacgccgcccgacatggcggacgccgcctctggccgcggccacgtcgtctaccctccccgctccgccgaggacatcttcaaggactaccgcgcccgccggtccgccatcctccgcgccctcactcacgaggtcgaggacttctacgcgcagtgcgatccagacaaggagaacctgtgcctgtacggctacgcgaacgaggcgtgggaggtggcgctgccggcagaggaggtgcccacggagctgccggagcctgcgctggggatcaacttcgcgcgcgacggaatgaaccgccgcgactggcttgcgctcgtcgccgtccactccgactcgtggttcctctccgtcgccttttactatgcggctcggcttaatcgtaatgaccngaaacgctatttggaatgataatgaaatgcaaactgtttttgaagtggtccccgggggcaaacaaaaac

SEQ ID NO: 38217 - protein, 129 aa, Zea mays
  misc_feature: Ceres CLONE 1425947-F
  misc_feature (124)..(124): Xaa is any aa, unknown, or other
MADAASGRGHVVYPPRSAEDIFKDYRARRSAILRALTHEVEDFYAQCDPDKENLCLYGYANEAWEVALPAEEVPTELPEPALGINFARDGMNRRDWLALVAVHSDSWFLSVAFYYAARLNRNDXKRYLE

SEQ ID NO: 38218 - DNA, 644 bp, Zea mays
  misc_feature: Ceres CLONE 1425948-F
  misc_feature: Encodes the peptide sequence at SEQ ID NO. 38219
aaagctggagctccccgcggtggcggccgctctagaactagtggatcccccgggctgcaggaattcgcacgagaccattacctagaacatcctaatcgaaaactaatcgagcatcgcaaagataggcgtcttcgtactcgcctacctccgcggctcaaacctttcccccttctcccaattccctccgtcggccgccgctccatcccgtacgacgacaccatgagggagtgcattatcgatccacatcggccaggccggtatccaggtcggaaacgcgtgctgggagctgtactgccttgagcatggcattcaggctgacagtcagatgcccagtgacaagaccattgggggaggtgatgatgctttcaacaccttcttcagagagactggtgctggcaagcacgtgccccgtgctgtttttgttgaccttgaacccactgtcatcgatgaagtgaggactggcacctaccgccaactcttccaccctgagcagctcatcagtgggaaggaggatgcgtccaacaactttgcccgtggtcactacaccattggcaaggagattgttgacctatgccttgatcgcataacgaatcttgccgaccactgcagtgatctccagagcttcctcgtcttcaacgatgatg

SEQ ID NO: 38219 - protein, 106 aa, Zea mays
  misc_feature: Ceres CLONE 1425948-F
  misc_feature (14)..(106): Pfam Name: Tubulin Pfam Description: Tubulin/FtsZ family, GTPase domain
MPSDKTIGGGDDAFNTFFRETGAGKHVPRAVFVDLEPTVIDEVRTGTYRQLFHPEQLISGKEDASNNFARGHYTIGKEIVDLCLDRITNLADHCSDLQSFLVFNDD

SEQ ID NO: 38220 - DNA, 633 bp, Zea mays
  misc_feature: Ceres CLONE 1425949-F
aaagctggagctccccgcggtggcggccgctctagaactagtggatcccccgggctgcaggaattcgcacgagaccattacctagaacatcctaatcgaaaagttccgcaccccacggcaggcgcttgagagtacttgactactaccctcccaactgcgaaactgcaacgccgttgcttcgactcaactccagcatccctcgtccccgtatcaccgagacgccgacacaccgctcgctttcgctccagagacccgggcctgccgagccgccgccatggacgaggagtacgacatgatcgttctgggcacgggggtcaaagaatgcatcctcagcggactcctctctgtcaacagcctctaggttctacacatgcatagaaatgattactacggaggagattccgcctacctaaacctgaaccagatctggaagaggtttacgggggaagacaagccaccggtccatctaagtgcgagcgaagattacgatgtggacatggttcacaagtttatgatggcacacgggactttggctcgcactctcattcacactgatgtgacaaaatatttgccatgcacagcggttgagggaagctatgtcttcagggagcggagatttcgaggttcctgccc

SEQ ID NO: 38221 - DNA, 645 bp, Zea mays
  misc_feature: Ceres CLONE 1425966-F
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaaaggctacaactaggagcccgagaacaacccctccgacgtctccaccattccgccgttcccaccacgccactcgacagttcggcactcactcctgtctcccccccttgccgagacggcgcggacgacccgtcgcccacaccgaaggctgacactctcctcgacgccgccacggcatcgcgccagagctcctcccaacccgcacgcacgggagacaccacgggcttacaacccctagcatcaacaccataatacgcctggcgcgctcatcggtctcattgaatcaacacgtcaagaggtcactacgggcagattcacgaggacactgtttctcgaggaggggagcatcccggggcagccgcgtcatctccgccctactacgagagcagactgaggcgtcataggtggctgatgaccatgatgacatcaactaggcacataagcgctgaggaagactcatgaagcatgagatggaaatgcatggagcagctcaaggcatgatggccactgataaggcaggcaccatgtcagtgcagagctaagagn

SEQ ID NO: 38222 - DNA, 554 bp, Zea mays
  misc_feature: Ceres CLONE 1425973-F
  misc_feature (51)..(51): n is a, c, t, g, unknown, or other
  misc_feature (52)..(52): n is a, c, t, g, unknown, or other
  misc_feature (81)..(81): n is a, c, t, g, unknown, or other
  misc_feature (82)..(82): n is a, c, t, g, unknown, or other
  misc_feature (95)..(95): n is a, c, t, g, unknown, or other
  misc_feature (96)..(96): n is a, c, t, g, unknown, or other
  misc_feature (114)..(114): n is a, c, t, g, unknown, or other
  misc_feature (266)..(266): n is a, c, t, g, unknown, or other
aaagctggactccccgcggtggcggccgctctagaactagtggatcccccnngggctgcaggaaattcgcacgaagaccannttacctagatcanntcctaatcgaaaacccgngcccgcgacctcagctctctcttgtctcgcccgctagctcccatcccagcctcccaccgcgcccgcctgccccaacatcccccctccccgctccgctccaagcacggttccagatctgctacggcggcggccggtggaacgccgccccccgnccgcgttgccggggaaaagggcagtgacgtgagcggaggatcctgcccggcggtgcatgctagcgaacaatgacgcggtaagcgggcggcggaagaaaccgggccccccccggcccctaatcccgaagtcaatgggcgtgggctccttgggcaaaaaatgacaattaatggggaatccccccaatgggttgggtaagctcaggaaaaacttttctttcttttggggggaaaactcttttaaaaacaaaaaaaaattagtgggcccttaaagcccccctgagaagaagt

SEQ ID NO: 38223 - DNA, 713 bp, Zea mays
  misc_feature: Ceres CLONE 1425976-F
ggagctccccgcggtggcggccgctctagaactagtggatcccccgggctgcaggaattcgcacgagaccattacctagaacatcctaatcgaaaaattgttgattgattgatcttccccgcctctctcctttgtctcctcgtttttgggtggctcgctcccctcggggtggtggaggagggcagtttaaaccctaggggctctggacggagcgtgcggttaagactgctccgggtctcgagaggggaaggtgcttttatcgctgctccttccttcttgggctgcaatcgttcggaccggcggctgcattcgccctctgcaacgccaaaaaaaacatggggtcatgggaggtggtcgctgccacccaaaacgaggtcacccttggagaccggcggcacggactggcctaggaggcctctgatgcccctcgtgagctcgccggaggcaagggcctggttgactctgtcttccgagctcgcctgggaaccaggaactcaccatgccgtgcttacctcgtatcagtacattcgccgaggacgtcctcagtggctgttggacaacctgctgcatgggctttccattgctcctgctttcatgaacgggcttgttgttcacatcgtaccgaacttcttagacttgccctggcccgatgttccacttattttgaggtctttgtcgatgacctcggtcacggaaaatccttaccttagtgc

SEQ ID NO: 38224 - DNA, 651 bp, Zea mays
  misc_feature: Ceres CLONE 1425979-F
  misc_feature: Encodes the peptide sequence at SEQ ID NO. 38225
aaagctggagctccccgcggtggcggccgctctagaactagtggatcccccgggctgcaggaattcgcacgagaccattacctagaacatcctaatcgaaaaattgattttttttccgcgcagccgatttcttttcgtctctctcgctctcgccttctcggcgcagcgcagtactacgagctagcagcaccaggaacctcttcccacacttccgcgctcctccctctgtctcgagactcgagaatggttgtgtaggcgggcgcaggagggagggaggcgagagggggagctagggtttttcgccgccgccttctgttatcctcaggctctgaaccccctcctgtccggtgcgcggcggattagactccgatggggaagtctccggcgaagtggatcaagtccgtgctcttcgggaagaagtcgtcgtccaggtccggctccaccaaggccaaagatttatcgaaaggtgcgagtaacaaaggagctgctgctgcggggaaggagcccgtgttctctgagagctccccagtgatctcggagcctgtacttgttagcgcccacaacaatgagaccgtgcgggaggtggcgaagggtgagaattccagcgtgcaagaagtgccagtgaccgatgtcagtcaagtcttggagaag

SEQ ID NO: 38225 - protein, 94 aa, Zea mays
  misc_feature: Ceres CLONE 1425979-F
MGKSPAKWIKSVLFGKKSSSRSGSTKAKDLSKGASNKGAAAAGKEPVFSESSPVISEPVLVSAHNNETVREVAKGENSSVQEVPVTDVSQVLEK

SEQ ID NO: 38226 - DNA, 582 bp, Zea mays
  misc_feature: Ceres CLONE 1425984-F
  misc_feature: Encodes the peptide sequence at SEQ ID NO. 38227
  misc_feature (362)..(362): n is a, c, t, g, unknown, or other
  misc_feature (443)..(443): n is a, c, t, g, unknown, or other
  misc_feature (582)..(582): n is a, c, t, g, unknown, or other
aaagctggagctccccgcggtggcggccgctctagaactagtggatcccccgggctgcaggaattcgcacgagaccattacctagaacatcctaatcgaaaacatttttggtcttgctcttggatacaagtcggttatcatcccgattttcgctattgctgttagcatctatgtcagtttctccattgctgcgatgtacggcattgcagttgccgctcttggtatgctgagcacaatcgcaactggtcttgctattgatgcttatgggtccatcagtgacaatgctggtggtattgctgagatggctggaatgagccacagaatccgtgagagaactgatgctcctgatgctgctggcaacncaactgctgctattggaaagggtttggcattgggtcagctgctcctgggtcccttgcgccttttgggggccttggcacccnacttgaatgagaggttttcaaaatcccttccccaaggttttcattgtttggattgggggagccatgcttcccaaacggttctcggcccggacccagaaaaagggttggaaacccccccctaaaaaggggggagaaagcn

SEQ ID NO: 38227 - protein, 123 aa, Zea mays
  misc_feature: Ceres CLONE 1425984-F
  misc_feature: SWISSPROT Homolog: EC 3.6.1.1 Inorganic diphosphatase
  misc_feature (57)..(57): Xaa is any aa, unknown, or other
  misc_feature (84)..(84): Xaa is any aa, unknown, or other
MYGIAVAALGMLSTIATGLAIDAYGSISDNAGGIAEMAGMSHRIRERTDAPDAAGNXTAAIGKGLALGQLLLGPLRLLGALAPXLNERFSKSLPQGFHCLDWGSHASQTVLGPDPEKGLETPP

SEQ ID NO: 38228 - DNA, 627 bp, Zea mays
  misc_feature: Ceres CLONE 1425995-F
  misc_feature: SWISSPROT Homolog: EC 3.4.25.1 Proteasome endopeptidase complex
aagctggagctccccgcggtggcggccgctctagaactagtggatcccccgggctgcaggaattcgcacgagaccattacctagaacatcctaatcgaaaaaggtcttcctctcgggagttgcggtctcgcgcccccctccgccgaccgccgcgtcctcacaaccgcggaagctgcttccctctccattggacgcggccggcttccatgtctcggtcgcctccctctacatcccacggccgctaccaccttccctctaactcacacggccgccggcctctccaaggtctgctcacggaaaaaccttgtttcgagtcgacgacgctccttcccggaagagctaacgaggtgactccccaccgcgccattgggtgacagctagtactccttctccctcaccaccttcagtccgtccgggaagctcgtgcatattgagcacaccctcacgggtgtctgatccgggaatacctccctcgggatcaaagctgcccatggtgtatgcattgcctctgagaagagcctgccttctattttagcgcatgaaacatctgtgcgaaacattcacgcactaacacctaatattggagttgtctatagcgggatgggtccagatttcagtgttctggtg

SEQ ID NO: 38229 - DNA, 655 bp, Zea mays
  misc_feature: Ceres CLONE 1425998-F
aaagctggagctccccgcggtggcggccgctctagaactagtggatcccccgggctgcaggaattcgcacgagaccattacctagaacatcctaatcgaaaaatccattgttgtggacctgtcacgtgtggtggttgcgttgtggggcaccaatttctagcgggtgttcaattttggtgcccgatttttaaggaggatccaatttaggaagaattttggttttaggtacaatggttttggactgcctgatattctaatcataagtaggccaacggctttggagtagacaatttttttcccggaaaacaacagccatttttctagatgagctactcttcaatcaatccagtgaatctgagctctggaagaacaaactttcctaattacaccccgtatttcgtgcttggccgctggcttctaaaatctaatttatttgtcgcgtttcagtgcaccaatgaacatatatctctgtttactcagcccaaaatctttccgcaggatctacttgtgaatcgcgtatgaatgttgattatcggagatattcttgttaatttaggatttcaattccgtcgatccaaccgaacacctaattatgcctgatatcttcgcaattgtcgctcccatcaagacgctcgacgccttgtttttttcagtg

SEQ ID NO: 38230 - DNA, 637 bp, Zea mays
  misc_feature: Ceres CLONE 1426003-F
  misc_feature: Encodes the peptide sequence at SEQ ID NO. 38231
aaagctggagctccccgcggtggcggccgctctagaactagtggatcccccgggctgcaggaattcgcacgagaccattacctagaacatcctaatcgaaaaaactactccgtcactttgttagcaaagctcctcctcgatccatccatcactgcaccggccggaggcaccgcgctcacaaggactaaccaacgagaaggcagcaatggcagaccgtgaccgcaacggcatctaaggcggcgcccacgccacctacgggcaccagcaacatcaggaaggaggcgcgcgcccgatgggtgagcacgtgaagggcatgctccacgacaaggggccgacagaatcgcatgcgctgacagtgctgacactgatcccgctggacgggctgctagctggtgctgtcggggctggcgctgacggcctccgaggtgggactggccatggccaagacagaattcctgatcttcagccccgtgctcgtccccgacacgatcctcatcgagactgccgtcatggggttcctcacttcgggagcgctcgggctcgagagcctgaccaacctcacgtgcctcgcaaacaacgagacgacatgcattaccacacaccccggactacgtggaggacgctcaccacaagatgg

SEQ ID NO: 38231 - protein, 66 aa, Zea mays
  misc_feature: Ceres CLONE 1426003-F
MAKTEFLIFSPVLVPDTILIETAVMGFLTSGALGLESLTNLTCLANNETTCITTHPGLRGGRSPQD

SEQ ID NO: 38232 - DNA, 662 bp, Zea mays
  misc_feature: Ceres CLONE 1426031-F
  misc_feature: Encodes the peptide sequence at SEQ ID NO. 38233
tggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaagggtgggtgaagtggctcagtggcgtcatcgacaatgccctgtaccccgtcctcttcctggactacctcaagtccgccgtgcctgccctgggcggcggcc

SEQ ID NO: 38233 - protein, 142 aa, Zea mays
  misc_feature: Ceres CLONE 1426031-F
MGECRTEYRGLPDANGEDAGTVPAALRKVSIVPLVFLIFYEVSGGPFGIEDSVGAAGPLLAIVGFLVLPVIWSIPEALITAELGTMFPENGGYVVWVASALGPYWGFQQGWVKWLSGVIDNALYPVLFLDYLKSAVPALGGG

SEQ ID NO: 38234 - DNA, 649 bp, Zea mays
  misc_feature: Ceres CLONE 1426038-F
  misc_feature: Encodes the peptide sequence at SEQ ID NO. 38235
  misc_feature (468)..(468): n is a, c, t, g, unknown, or other
  misc_feature (493)..(493): n is a, c, t, g, unknown, or other
aaagctggagctccccgcggtggcggccgctctagaactagtggatcccccgggctgcaggaattcgcacgagaccattacctagaacatcctaatcaaaaaaaatcctccgaacctcggcgcgcacaagtgatctatggtgctggcatggctgcatgcgtgcccggttgactccctacttcggggggctctcgctccaaacccccaacttggatcgtacctcggaatcgcacctatatactgtgagctgccccgctctgacttcgtcgaccgcttgctcggatcaggacgctcccagatctcctacctcgataagtccatgctgccacagaaaggaccgactgctaagcaagtcatcattgaggaccacctggtccagcagggcgccctgcctgctgccgctgttcccttggcctagaggcactcataggaggtcatgccgtacccacgtctgtgtactgatcgttnctccgtgctgctcggcgcggactgngtcatgccacggacgatgtgtagtatcgcaaatgctgacgtctcgaggtcgggggctgtcattggcacttagctcgagagctcgcgtgggactgattacatgcagcccggacgtactttacgatgcgcaccgaggatgtgccacgctgcagcacaa

SEQ ID NO: 38235 - protein, 93 aa, Zea mays
  misc_feature: Ceres CLONE 1426038-F
MVLAWLHACPVDSLLRGALAPNPQLGSYLGIAPIYCELPRSDFVDRLLGSGRSQISYLDKSMLPQKGPTAKQVIIEDHLVQQGALPAAAVPLA

SEQ ID NO: 38236 - DNA, 657 bp, Zea mays
  misc_feature: Ceres CLONE 1426050-F
  misc_feature: Translation starting site: 277
aaagctggagctccccgcggtggcggccgctctagactagtggatcccccgggctgcaggaattcgcacgagaccattacctagaacatcctaatcgaaaaatcacgaacaccgttctccatatcgtggagtctggaggaaggaaagaggagggggccgcctagggcttccattccgcatcaatgaaccccgctgacgtgtggggcccctcctcgtcctcgtcttcttcttccgccgcctgcacgaggcccctgcatgcgcacttctttctgtagcatggggatttactactcggactcctgcttggactatgtcacggatccccgctccgaggagcaatcctacgcctgtcctcttctgctgagacgacttctacttcctcggactctgctgtcgcatctaccacaacgctgctcattgacgctttcacctggacatgtcccatctgtgctcttcgtccgcaatgcacttgataccaccttctgactatccgacatgtaagttacttcaagatccaacgcacgcacagagtccgaacgatatctcctgggtcccattctttataatcttgagtgagaaaagactttaaagatgacacttctcaacctgttctccgtggatcatcctatgtgtccaatcctcctgatataccaccat

SEQ ID NO: 38237 - DNA, 1006 bp, Zea mays
  misc_feature: Ceres CLONE 1426050-R
ttgggtaccgggccccccctcgaggtcgacggtatcgataagcttttttttttttttttttgttctgatttttcatttcattcatagccaacggggacggaacaggtaacacggaacggtagcggcgtcacatctaacggtagccagaacatctcggaacctacgcgatggagcgagatctagggtactcgggaggcgagcgataacacttttggtagacaggtaaaaaaaggatcggtaactaggataactggccagcgagcggccccaccattcactccctccagttgccgccgccggagccgccgcggctgccgccgtaaccgccgccgccgccgccgctgccgtagcctcctccgcccctcacggcttgcgtagccaccgcctgccgccgctgcagccacctccttaggcgccggcgccgtcgaagtataccgacccggctcctccgtttgttaaaatgggcacattaatctgtaacactattccttcttacgtaaataatcttaaagtcggggttcctccgggagcgttattaaatggggtccctcctatgtcggcgggattgaccgcagggtggatccaggtatccggagtattgtgcgatgaggtcacatcattcgacattggtaatcacacacgcccattttacgccacacgcggaggcggggtgggactcctgggtgcgtgcgagaggtctaagtcggcggaaaaattacctcagtgtaagcattatagaacaccgctttgacgcccacacaatagctaagaaattgattagttgtggggggggtgcgattattatggctgggaggatatcggtgtgggcagctgatgattaatgtgaacgcagggaattcatagtgtgttgggggggtacgatgtaataggtgagttgtggattgtatgagtgtcgagattttatataccgataatacagctggggtgcggagtaaatatggaggtcgttgatgtgcgggttatcgcagacagagttataagctgg

SEQ ID NO: 38238 - DNA, 674 bp, Zea mays
  misc_feature: Ceres CLONE 1426056-F
  misc_feature: Encodes the peptide sequence at SEQ ID NO. 38239
  misc_feature (408)..(408): n is a, c, t, g, unknown, or other
aagctggagctccccgcggtggcggccgctctatactagtggatcccccgggctgcaggaattcgcacgagaccattacctagaacatcctaatcgaaaactatcatcatccaatccagatcagcaaagcggcattgcgtagagaggatcgtcgaacagaacagcatgaagatggtcatcgttctcttcgtgtgcctggctctgtcagctgccagcgcctctgcaatgcatatgccctgcccctgcgcggggctgcagggcttgtacggcgctggcgccggcctgactacgatgatgggcgccggcgggctgtacccctactcagagtacctgaggcaaccgcagtgcagcccgctggcggcggcgccctactacgccgggtgtgggcagacgagcgccatgtaccanccgctccggcaaaagtgctgccagcaccagatgaagatgatggacgtgcagtccttcgcgcagcagctgcagatgaagatgcagcttgaagctggcgcttgcgccagccgcagcctggacgaaaccagctttgaagcggcacccccaacaggtggggggagccccagggtcccaaaccccatggtccttgaagaatgggggccaaacattggcgggccatgtgggggaactctacacaagacccagggaacagccttccccaagct

SEQ ID NO: 38239 - protein, 169 aa, Zea mays
  misc_feature: Ceres CLONE 1426056-F
  misc_feature (81)..(81): Xaa is any aa, unknown, or other
MKMVIVLFVCLALSAASASAMHMPCPCAGLQGLYGAGAGLTTMMGAGGLYPYSEYLRQPQCSPLAAAPYYAGCGQTSAMYXPLRQKCCQHQMKMMDVQSFAQQLQMKMQLEAGACASRSLDETSFEAAPPTGGGSPRVPNPMVLEEWGPNIGGPCGGTLHKTQGTAFPK

SEQ ID NO: 38240 - DNA, 668 bp, Zea mays
  misc_feature: Ceres CLONE 1426065-F
aaagctggagctccccgcggtggcggccgctctagaactagtggatcccccgggctgcaggaattcgcacgagaccattacctagaacatcctaatcgaaaaacttacctggagagaaatttgctattttgccactctcaattttggctgcctgttattataccatcccgtgtctatgactagtgggaccgtctgtgtctatgatttatgggttcgatggtatattggcgaagcccacaaatgataatggcaaaattgtcaatggcctaggccagtgactctcattgcacttggacggtaggccagtgactctcattgcacttggagggtacgctgacttaccatctccccaagggtacgctgacttaccatctccccaagtgggagagtggacgtcataatttgtgttagaggggtcataatttgtccagtgactctcattgcacttggagggtacgctgacttaccatctccccaagtgggagagtggacgtcataatttgttaccatctccccaagtgggagagtggacgtcataatttgtgttagacttaccatctctccaagtgggagagtggacgtcataatttgtgttagaggggtcataatttgtgttagaggccgtgcggcctctgccaaatcgaatatattaatttttttgtctggtt

SEQ ID NO: 38241 - DNA, 649 bp, Zea mays
  misc_feature: Ceres CLONE 1426074-F
  misc_feature: Encodes the peptide sequence at SEQ ID NO. 38242
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaacccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccggtggcgtcctgggcgagatgcaaggtacaagaagactgagatctgccagacatgttgcaagctaaagaatgtctgccaggtctgcctgctggatcttgaatatggtctgcctgttcaggtccgagatacagcactctctatcaattccaatgatgcaattccaaggagtgatgtcaatcgcgaatattttgcagaagagcatgataggagggccagagctggcatagactatgattcatcctatgggaaggctcgtccaaatgatacaattctgaagctacagagggacagcccantattccaagagggacggagctcctgttttggcgtttt

SEQ ID NO: 38242 - protein, 165 aa, Zea mays
  misc_feature: Ceres CLONE 1426074-F
  misc_feature (154)..(154): Xaa is any aa, unknown, or other
MAHRLLRDAQADGWERSDFPIICESCLGDNPYVRMLRAEYDKECKICARPFTVFRWRPGRDARYKKTEICQTCCKLKNVCQVCLLDLEYGLPVQVRDTALSINSNDAIPRSDVNREYFAEEHDRRARAGIDYDSSYGKARPNDTILKLQRDSPXFQEGRSSCFGV

SEQ ID NO: 38243 - DNA, 550 bp, Zea mays
  misc_feature: Ceres CLONE 1426077-F
  misc_feature (219)..(219): n is a, c, t, g, unknown, or other
  misc_feature (238)..(238): n is a, c, t, g, unknown, or other
  misc_feature (239)..(239): n is a, c, t, g, unknown, or other
  misc_feature (270)..(270): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (324)..(324): n is a, c, t, g, unknown, or other
  misc_feature (325)..(325): n is a, c, t, g, unknown, or other
  misc_feature (328)..(328): n is a, c, t, g, unknown, or other
  misc_feature (329)..(329): n is a, c, t, g, unknown, or other
  misc_feature (380)..(380): n is a, c, t, g, unknown, or other
  misc_feature (381)..(381): n is a, c, t, g, unknown, or other
  misc_feature (407)..(407): n is a, c, t, g, unknown, or other
  misc_feature (477)..(477): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (509)..(509): n is a, c, t, g, unknown, or other
aaagctggagctccccgcggtggcggccgctctagaactagtggatcccccgggctgcaggaattcgcacgagaccattacctagaacatcctaatcgaaaaacagtctcaccacagcgagcgagagcaaggcgcccaagcaaccaccgcgagaacaagtcgcagccaaacagccccgtctcccagcgaagcttgagcttgcattattctaccatgtcnttccatgggagctgctccnnacgccgtccgttcccccggaaaaacccaaanccnnnngggaaagaaggtcccccccccccnnnngcggcccgaccccccaaaggnnacnnccccccccccggccccgggggggggggaaaaaaagggggcgcccccccccnnactgccccccccgggggggggggggnggccccaaaaaaaaaaaaccccctctcccccccccccccccgttgtttttgggaggggagaagaaaaaanannnaaaaaaaaaaccgcgggcggggttgggnccccccccccaaatgaggtttttcctcccccccgcgggggg

SEQ ID NO: 38244 - DNA, 691 bp, Zea mays
  misc_feature: Ceres CLONE 1426079-F
  misc_feature: Encodes the peptide sequence at SEQ ID NO. 38245
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaacacttcatcaacgggcaaaccaactaacccggggtggcccggaacgggccaacgttccaattcctggggtccccatccctgcccgggtggggggccccgggtccaaaatggggggggtggcaccagtgggccccgtgggccaaaaaatcttgggccaaaaagcccggggtttccttttatgctgggggcaaaaagggcccctccccttgggggggggcgcagaaagaaatcccatttggggaaaacaccgggg

SEQ ID NO: 38245 - protein, 40 aa, Zea mays
  misc_feature: Ceres CLONE 1426079-F
MAGIGRNMVAPLLVLNLIMYIIVIGFASWNLKHFINGQTN

SEQ ID NO: 38246 - DNA, 680 bp, Zea mays
  misc_feature: Ceres CLONE 1426091-F
  misc_feature: Encodes the peptide sequence at SEQ ID NO. 38247
  misc_feature (565)..(565): n is a, c, t, g, unknown, or other
  misc_feature (575)..(575): n is a, c, t, g, unknown, or other
  misc_feature (581)..(581): n is a, c, t, g, unknown, or other
aaagctggagctccccgcggtggcggccgctctagaactagtggatcccccgggctgcaggaattcgcacgagaccattacctagaacatcctaatcgaaaagacgacactgcacacctctcaccagtccccacacggccacaccacacccagctgtccccatcgcgcgcacactctctcggtctctccctcccagtcccagcgtttgcggtccagtccagagagctcgagcagccatggcggctcccctgttcctcctcctcctgctgctggctatgttcacaggctcagacgcggcgttctgcgtgtgcaagacgggcgtgcccgaccaggcgatgcaggcggcgatcgactacgcctgcgccaagggggccgactgcgcctccgcctccaagggcgcgccctgctacggcaacggcaacaaggtggccgtctgctcctacatctgcaacagctactaccagagccgcagcgccacgggcgccacctgcgacttcaacggcgtcgccacgctcaccggcaccgaccccagctccggcaactgcaagttcgccctcggccccancaacgcaggnaacggncggtggcatgggccctggcccggtttaccgccggtggatgggcccctgcacccgggccccgggaaaagctttgaccccgaacaggcccgggcatggccc

SEQ ID NO: 38247 - protein, 148 aa, Zea mays
  misc_feature: Ceres CLONE 1426091-F
  misc_feature (21)..(105): Pfam Name: X8 Pfam Description: X8 domain
  misc_feature: SWISSPROT Homolog: EC 3.2.1.39 Glucan endo-1,3-beta-D-glucosidase
  misc_feature (110)..(110): Xaa is any aa, unknown, or other
MAAPLFLLLLLLAMFTGSDAAFCVCKTGVPDQAMQAAIDYACAKGADCASASKGAPCYGNGNKVAVCSYICNSYYQSRSATGATCDFNGVATLTGTDPSSGNCKFALGPXNAGNGRWHGPWPGLPPVDGPLHPGPGKSFDPEQARAWP

SEQ ID NO: 38248 - DNA, 664 bp, Zea mays
  misc_feature: Ceres CLONE 1426092-F
  misc_feature: Encodes the peptide sequence at SEQ ID NO. 38249
  misc_feature (273)..(273): n is a, c, t, g, unknown, or other
  misc_feature (285)..(285): n is a, c, t, g, unknown, or other
  misc_feature (296)..(296): n is a, c, t, g, unknown, or other
  misc_feature (339)..(339): n is a, c, t, g, unknown, or other
caaagctggagctccccgcggtggcggccgctctagaactagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaaggggtcgcatttgatgacnagcagtatgacnagaaaatgcanggagatattactgaaagacttctcacttcatatgatgatgttngtggaaagtttgaccgcatgggactgcaagagacctttctgaaaggatctatggcctatggttttgaaaaaccctcggcttattcagcaagggggaatagttccttctgcaggggcttgacttgattcaccagccccatcctggaatgggaaaaccgctaccttctggtttggaatcttggacaacttaattatggaatgggtgaaagccccgcatttgttcttgccccaccccgggggtttgccccaaaatttgaaaggtttcccgcgccctgggggaatttttgggggtaaaaaccctcccccgttttggggaaaacctcttt

SEQ ID NO: 38249 - protein, 76 aa, Zea mays
  misc_feature: Ceres CLONE 1426092-F
  misc_feature (14)..(14): Xaa is any aa, unknown, or other
  misc_feature (18)..(18): Xaa is any aa, unknown, or other
  misc_feature (21)..(21): Xaa is any aa, unknown, or other
  misc_feature (36)..(36): Xaa is any aa, unknown, or other
MAGLAPEGVAFDDXQYDXKMXGDITERLLTSYDDVXGKFDRMGLQETFLKGSMAYGFEKPSAYSARGNSSFCRGLT

SEQ ID NO: 38250 - DNA, 650 bp, Zea mays
  misc_feature: Ceres CLONE 1426094-F
  misc_feature: Encodes the peptide sequence at SEQ ID NO. 38251
  misc_feature (353)..(353): n is a, c, t, g, unknown, or other
  misc_feature (354)..(354): n is a, c, t, g, unknown, or other
  misc_feature (390)..(390): n is a, c, t, g, unknown, or other
  misc_feature (397)..(397): n is a, c, t, g, unknown, or other
caaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatggataagctttcagtatggtgaaaaaccccagctcttcagccctataggctccnnacagcaatcgcagcaagcacatacctttatcacccnttgttgnttcacaatcgccagccctatctttggtgagtcattggtacaaacattcagggaaagaagctgcagcaatcgtgctactgtggatcaaaccagtaagtttggaaaacctttttcctatttctaaaaaaaaaaatttttttcatttaaccaaaatggtacaaccgaaaccgggtggctttatttggggcaaaaaaaattttcccatttgccccgcgttgtgtttggggtatttcttgaaaaaaaaaaaatttttt

SEQ ID NO: 38251 - protein, 49 aa, Zea mays
  misc_feature: Ceres CLONE 1426094-F
MATKIFSLLMLLALSACVANATIFPQCSQAPIASLLPPYLPSMDKLSVW

SEQ ID NO: 38252 - DNA, 655 bp, Zea mays
  misc_feature: Ceres CLONE 1426095-F
  misc_feature: Encodes the peptide sequence at SEQ ID NO. 38253
  misc_feature (477)..(477): n is a, c, t, g, unknown, or other
  misc_feature (509)..(509): n is a, c, t, g, unknown, or other
  misc_feature (548)..(548): n is a, c, t, g, unknown, or other
  misc_feature (605)..(605): n is a, c, t, g, unknown, or other
  misc_feature (637)..(637): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaaaccgctgctccacacgggcacacctttgcctcgcccaaccgctgcctcgctcgcgtccgccattccccagacctcgagagctaccgtctggtccgatcggacggaccccttcgcgcgccccagagatttcaggtaaggtgctgtaacagaagatgcaagggggaagaggtgggaggcagggcttattcggtttcggggacccttctggtggttccggtggctttggacaaccagggagccttatgcctggtttttttggtggcgcaaatccctttgacgaccctttcttcacaaacccctttggtagcatgatgcagactagtttctcagcccctttcagcggcatgatgcaacctagcttcatgaaccccttcngcagcatggtgcaacctagcttgcttggaccnagtatgtttgcgccccatgggcatctcaatggaggcatngttggaagccagacacatctcagtcaaggtatcagcaatggcagtggttccattcancaggcccctggaaccagcaagcctaaaggccnaattatcanggagtttct

SEQ ID NO: 38253 - protein, 133 aa, Zea mays
  misc_feature: Ceres CLONE 1426095-F
  misc_feature (75)..(75): Xaa is any aa, unknown, or other
  misc_feature (98)..(98): Xaa is any aa, unknown, or other
  misc_feature (117)..(117): Xaa is any aa, unknown, or other
  misc_feature (128)..(128): Xaa is any aa, unknown, or other
  misc_feature (131)..(131): Xaa is any aa, unknown, or other
MQGGRGGRQGLFGFGDPSGGSGGFGQPGSLMPGFFGGANPFDDPFFTNPFGSMMQTSFSAPFSGMMQPSFMNPFXSMVQPSLLGPSMFAPHGHLNGGXVGSQTHLSQGISNGSGSIXQAPGTSKPKGXIIXEF

SEQ ID NO: 38254 - DNA, 696 bp, Zea mays
  misc_feature: Ceres CLONE 1426096-F
  misc_feature: Encodes the peptide sequence at SEQ ID NO. 38255
  misc_feature (598)..(598): n is a, c, t, g, unknown, or other
aaagctggagctccccgcggtggcggccgctctagaactagtggatcccccgggctgcaggaattcgcacgagaccattacctagaacatcctaatcgaaaatcctcccccctcaacaaccgcgagatcttcagctaccgctctctccggtcgcgtttgcatccgcattcctcagatccagattcgagccccagccccgcttcgagatccagctagctctctatcaagcatccggcggagcgagcagcgggaggctcggcaagagagaagatgaagcggaagacgcggaacaagatcatcgtatggacgctggccctggctgcagtggcgattctggtgggtggcacgattgcgctggtgctcacggcggggacgtgcaaggccaagatgaaggggtcgcaggaaaagatctgtaacaaggggtgggagtgctcggggagcaagtactgctgcaacgacaccatcaccgacttcttcaaggtgtaccagttcgaggacctctttcgccaagggaacaaccccggtcgcgcacgccgtcgggttctgggactaccaggccttcaatcacgcccggggccctcttcgaagccccaggggnttctgcccccaccggcgggaagccaaaggccgatgatggaacttctgcccctttcccgggggacgtcggccccaaaaattattggggggaacggcggg

SEQ ID NO: 38255 - protein, 142 aa, Zea mays
  misc_feature: Ceres CLONE 1426096-F
  misc_feature (110)..(110): Xaa is any aa, unknown, or other
MKRKTRNKIIVWTLALAAVAILVGGTIALVLTAGTCKAKMKGSQEKICNKGWECSGSKYCCNDTITDFFKVYQFEDLFRQGNNPGRARRRVLGLPGLQSRPGPSSKPQGXLPPPAGSQRPMMELLPLSRGTSAPKIIGGNGG

SEQ ID NO: 38256 - DNA, 706 bp, Zea mays
  misc_feature: Ceres CLONE 1426097-F
  misc_feature: Encodes the peptide sequence at SEQ ID NO. 38257
ggagctccccgcggtggcggccgctctagaactagtggatcccccgggctgcaggaattcgcacgagaccattacctagaacatcctaattgaaaagtgggtcacagggaccaattataacaactgtcagatcactattgactcctcatcctatgaaagagctacgtgtgaagggtacatatcagcatcatagagaagtaaaggctgcgcaatgtatcaagataactgcacagggccttgaacacgccgttgctggtacttccttacatgtgattggacctgatgtggacgtggacgaagccaagaaaacagccatggaagatatgaagtcagtcatgagcttggttgacaaaagtggtgaaggagtttacgtacaagcttcaacgttaggatctttggaagcattactagagttcttgaagtcaccagatgtaaaaatacctgtaagtggtattggcctaggaccagtgcataaaaaggatatcatgaaggccggtgtaatgctagagaagaagaaagagtacgctacggttttggcttttgacgtgaagataactactgaggctcgcgaactagctgacaacatgggagtcaagatcctctccgctgatattatctatcatctgtttgatcagttcaaaagttatgtcaaggatgtccgagatgaagaaaggaaagaacagcatctgaagtagtgtttccatgt

SEQ ID NO: 38257 - protein, 180 aa, Zea mays
  misc_feature: Ceres CLONE 1426097-F
MKELRVKGTYQHHREVKAAQCIKITAQGLEHAVAGTSLHVIGPDVDVDEAKKTAMEDMKSVMSLVDKSGEGVYVQASTLGSLEALLEFLKSPDVKIPVSGIGLGPVHKKDIMKAGVMLEKKKEYATVLAFDVKITTEARELADNMGVKILSADIIYHLFDQFKSYVKDVRDEERKEQHLK

SEQ ID NO: 38258 - DNA, 722 bp, Zea mays
  misc_feature: Ceres CLONE 1426099-F
  misc_feature: Encodes the peptide sequence at SEQ ID NO. 38259
  misc_feature (87)..(87): n is a, c, t, g, unknown, or other
  misc_feature (297)..(297): n is a, c, t, g, unknown, or other
  misc_feature (363)..(363): n is a, c, t, g, unknown, or other
  misc_feature (364)..(364): n is a, c, t, g, unknown, or other
  misc_feature (679)..(679): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgaagaccattacttagnaacatcctaatcgaaaaacccaccggcaccgcgccacggccgcgttcgtctcaacaggagccgatggccactctcgcgccacggccacatatcctcctcggcttgacaaggccgcagcccatagcgcttcgtgcctgcgccgccttctcccgctcccgccacgcgccagtcccaccgcgggccgcgcagccgcggcgcgtcttcctcggncttggcgctgccttcatcgaccaggcacccgcatgggcctcggcgggcactcgtcccgctctttcnntgccggaacgcgcccaggcaaggcgttccccagtcgagcaaattctcaaaaatgccagggggccaataaattccttttcagcctgaggacttccccgttttcaaaaatctaaaaaacctcgtttccaaccggtccccctttttgcccccccatggaaacaaaaaatccaagcttcccaaaaaaatttttgaaaatttttcccccaaaaaacctccgggggggggctttttggaaagggggcaaagggggggcccccattacccccccgataaaaaaaaaaaaaaaggggggggggggtgaaaaaaaaaaaaaacnnaaaaaaccctcctcttttctttttttgggcgaaaacaaacaa

SEQ ID NO: 38259 - protein, 99 aa, Zea mays
  misc_feature: Ceres CLONE 1426099-F
  misc_feature (72)..(72): Xaa is any aa, unknown, or other
MATLAPRPHILLGLTRPQPIALRACAAFSRSRHAPVPPRAAQPRRVFLGLGAAFIDQAPAWASAGTRPALSXPERAQARRSPVEQILKNARGPINSFSA

SEQ ID NO: 38260 - DNA, 591 bp, Zea mays
  misc_feature: Ceres CLONE 1426109-F
  misc_feature: Encodes the peptide sequence at SEQ ID NO. 38261
  misc_feature (591)..(591): n is a, c, t, g, unknown, or other
ctggagctccccgcggtggcggccgctctagaactagtggatcccccgggctgcaggaattcgcacgagaccattacctagaacatcctaatcgaaaaaccccgccgccgaagccaccgtgccgctagccttccccgccgccgcaaaatggccgcctccgcgcgacccctggttaccgtgagggccctggagggcgacatggccacggactccgccggtgttccgctggcggacgtcctccgcgcaccgatccgcccggacatcgttcgcttcgtccacaagctcctgtcctgcaacagccgccaaccctatgcggtgtcgcgtcgcgccggacaccagacctccgcggagtcctggggcacggggcgtgcggtatcccgtatcccccgcgttcctgggcgtggtacccaccgcgccggccagggagcgttcgcaacattgtgtcgtggtggacgcatgttcgccgccaacaagatctgggcgcgctggcaccgtcgcgtcaacatacacctttcgccgtgtcgcatcggcttcggattttccggcaacgcgtttcgtccctggttctccaacgtggccccgcggggagcn

SEQ ID NO: 38261 - protein, 148 aa, Zea mays
  misc_feature: Ceres CLONE 1426109-F
  misc_feature (23)..(146): Pfam Name: Ribosomal_L4 Pfam Description: Ribosomal protein L4/L1 family
MAASARPLVTVRALEGDMATDSAGVPLADVLRAPIRPDIVRFVHKLLSCNSRQPYAVSRRAGHQTSAESWGTGRAVSRIPRVPGRGTHRAGQGAFATLCRGGRMFAANKIWARWHRRVNIHLSPCRIGFGFSGNAFRPWFSNVAPRGA

SEQ ID NO: 38262 - DNA, 713 bp, Zea mays
  misc_feature: Ceres CLONE 1426117-F
  misc_feature: Encodes the peptide sequence at SEQ ID NO. 38263
  misc_feature (529)..(529): n is a, c, t, g, unknown, or other
  misc_feature (589)..(589): n is a, c, t, g, unknown, or other
  misc_feature (601)..(601): n is a, c, t, g, unknown, or other
  misc_feature (603)..(603): n is a, c, t, g, unknown, or other
  misc_feature (667)..(667): n is a, c, t, g, unknown, or other
  misc_feature (704)..(704): n is a, c, t, g, unknown, or other
  misc_feature (713)..(713): n is a, c, t, g, unknown, or other
ggagctccccgcggtggcggccgctctagaactagtggatcccccgggctgcaggaattcgcacgagaccattacctagaacatcctaatcgaaaaatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaacccacgagtgccggaagagctgatgggcggcatgctccgcggggtgcgccagtttcacgagggccccgtgggagcgaagcangcgctctactcgagggacctcgctcgcaacctgcgcttcgccctcaacttcgacctcttncaagctgctgcngncgactggcgcgacacgctcttctgcgaggtggctccgaaacccgccgcgcgggaggagctgccngagccactcaggaacgtgatgctggagtacggcgcgncggtgacan

SEQ ID NO: 38263 - protein, 191 aa, Zea mays
  misc_feature: Ceres CLONE 1426117-F
  misc_feature: SWISSPROT Homolog: EC 1.14.11.20 Desacetoxyvindoline 4-hydroxylase
  misc_feature (130)..(130): Xaa is any aa, unknown, or other
  misc_feature (150)..(150): Xaa is any aa, unknown, or other
  misc_feature (155)..(155): Xaa is any aa, unknown, or other
  misc_feature (189)..(189): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNPRVPEELMGGMLRGVRQFHEGPVGAKXALYSRDLARNLRFALNFDLXQAAAXDWRDTLFCEVAPKPAAREELPEPLRNVMLEYGAXVT

SEQ ID NO: 38264 - DNA, 649 bp, Zea mays
  misc_feature: Ceres CLONE 1426122-F
  misc_feature: Encodes the peptide sequence at SEQ ID NO. 38265
aaagctggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggagaaacaggtgaaggaaattgtgttgaaggctatgggacatgctataagcaaggcagtggctattgctgagatcataaagaagaggattcctggtttgcatcaagatacaataatcagttctgtcagtattactgatgtatgggagcccatttgagaaggacttgtaccattggagatgactcggcatgtttcaatgatatcgatttccttgtcacctaaggagg

SEQ ID NO: 38265 - protein, 93 aa, Zea mays
  misc_feature: Ceres CLONE 1426122-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGHAISKAVAIAEIIKKRIPGLHQDTIISSVSITDVWEPI

SEQ ID NO: 38266 - DNA, 651 bp, Zea mays
  misc_feature: Ceres CLONE 1426123-F
  misc_feature: Encodes the peptide sequence at SEQ ID NO. 38267
  misc_feature (651)..(651): n is a, c, t, g, unknown, or other
ctggagctccccgcggtggcggccgctctagaactagtggatcccccgggctgcaggaattcgcacgagaccattacctagaacatcctaatcgaaaaaaaaaaccctaattcgaacaaccgcgccgccgtcaccgactcaccgtcgtctcttgctcactcgctcgttctctccatccagatcggagcgctcggttcggataggggcgtctcggaggtgaaggcgggcgcgtcagccatggcggacgaggagcacccggagaggagggaagaggcctccgagcttgccccctttgatccaaccaagaagaagaaaaagaagaaggttgtcatccaagagccttctgatgaagtggacaagcttgcagagaagacagaatcactagcagtcgcagaacctgctgaacttaactttactggaatgaagaagaaaaagaagaagcaggtggatcttgattcatctattgatgaccttgtagatggggaggacactcaaggtgatcaagttgtagaggaacaaggggacggtattgtgcttggaggtggccctacatatccttgggaaggaactgaccgggattataaataccaagagctgctggacagggtgttcaacattcttcgtgagaacaacccagatcttgctggtgan

SEQ ID NO: 38267 - protein, 137 aa, Zea mays
  misc_feature: Ceres CLONE 1426123-F
MADEEHPERREEASELAPFDPTKKKKKKKVVIQEPSDEVDKLAEKTESLAVAEPAELNFTGMKKKKKKQVDLDSSIDDLVDGEDTQGDQVVEEQGDGIVLGGGPTYPWEGTDRDYKYQELLDRVFNILRENNPDLAG

SEQ ID NO: 38268 - DNA, 627 bp, Zea mays
  misc_feature: Ceres CLONE 1426125-F
  misc_feature: Encodes the peptide sequence at SEQ ID NO. 38269
  misc_feature (627)..(627): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccgggggcaccgcactcgaaggggctagccaacgagacggcagaaatggcggaccatgaccgcagcgaaatctacggcggcgcccacgcaacctacggacagcatcaacaacaggaaggaggcgagcgccccatggatgagcacgtgaagggaatgctccacgacaaggggccgacggcgtcacatgcgctaacggtggtgactctgttaccgctgggcgggatggagctggtgctgtcggggctggtgctgaccgcatccggggtggggatggccatgaccacgacggtgttcctgatcttcagcaccgtgctcgtccccgcagcgctgatcatcgggacggccgtcatgaggttcctcacgacgggcgcgctggggctagggggcttgtcatcgatcacgtgcctcgccaatacggtgcggcaggctttccagcgcaccacggacaccgtggaggatgcgcaccgn

SEQ ID NO: 38269 - protein, 141 aa, Zea mays
  misc_feature: Ceres CLONE 1426125-F
  misc_feature (44)..(141): Pfam Name: Oleosin Pfam Description: Oleosin
MADHDRSEIYGGAHATYGQHQQQEGGERPMDEHVKGMLHDKGPTASHALTVVTLLPLGGMELVLSGLVLTASGVGMAMTTTVFLIFSTVLVPAALIIGTAVMRFLTTGALGLGGLSSITCLANTVRQAFQRTTDTVEDAHR

SEQ ID NO: 38270 - DNA, 678 bp, Zea mays
  misc_feature: Ceres CLONE 1426129-F
  misc_feature: Encodes the peptide sequence at SEQ ID NO. 38271
  misc_feature (325)..(325): n is a, c, t, g, unknown, or other
  misc_feature (332)..(332): n is a, c, t, g, unknown, or other
  misc_feature (342)..(342): n is a, c, t, g, unknown, or other
ctggagctccccgcggtggcggccgctctagaactagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggntgagaangccagatccnaactcccatagaaggaaactggtgagggctgtaccatcattgaaacccctccctctgtcattggtgggctcggggcatatgtgaagactccccggggcctcgccaacctaattctgtttgggccaaactccttccgaaaaaggtggggaaaggttctacaaaactgggcaaaaacaaaaaaaaggtttcccaaaattgccccccaatataaaaaaggcggggcaaagggaaaatccccccccccttggaaaaaaaaaaaaaattttttgtttccgcgggtttgccccccccccaaaaaaaaaaaaggtggttaaaaaaaaaagcccccctttgtga

SEQ ID NO: 38271 - protein, 68 aa, Zea mays
  misc_feature: Ceres CLONE 1426129-F
  misc_feature (60)..(60): Xaa is any aa, unknown, or other
  misc_feature (62)..(62): Xaa is any aa, unknown, or other
  misc_feature (66)..(66): Xaa is any aa, unknown, or other
MSHRKFEHPRHGSLGFLPRKRSSRHRGKVKSFPRDDPKKPCHLTAFLGYKAGMTHIVREXEXARSXLP

SEQ ID NO: 38272 - DNA, 645 bp, Zea mays
  misc_feature: Ceres CLONE 1426132-F
  misc_feature: Encodes the peptide sequence at SEQ ID NO. 38273
aaagctggagctccccgcggtggcggccgctctagaactagtggatcccccgggctgcaggaattcgcacgagaccattacctagaacatcctaatcgaaaaatctatcgcactcgtactcgtacctcaagcatcaacggccggagctctgggcagcgtgcgcacgtggggtacctagctcgctctgctaacctaccatggctgatcaccaccggggtgcaacgggaggtggcgggggctacagcaacctccaacgcgggggcggcatgcacggcgaggcgcatcagcagcagaagcagggcgccatgatgacggcgctcaaggccgcgacggccgcgaccttcagagggtctatgctggtgctgtccgggctgatcctggccggcaccgagatcgcgctcacggtggccacccccgtgctggtgatcttcatacccgtgctggtgccggccgccatcgcgctggcgctcatggcggccgggatcgtcacctcctgcggactcggcgtcgctgcgctgtccgtgttctcgtggatgtacaagtacctgacaggcaagcacccgccagtgcgcgaccatcttgaccacgtcaaggagaggttggcgtccagggcccgcgaatcgaggatgcagcacagcacccgat

SEQ ID NO: 38273 - protein, 149 aa, Zea mays
  misc_feature: Ceres CLONE 1426132-F
  misc_feature (36)..(147): Pfam Name: Oleosin Pfam Description: Oleosin
MADHHRGATGGGGGYSNLQRGGGMHGEAHQQQKQGAMMTALKAATAATFRGSMLVLSGLILAGTEIALTVATPVLVIFIPVLVPAAIALALMAAGIVTSCGLGVAALSVFSWMYKYLTGKHPPVRDHLDHVKERLASRARESRMQHSTR

SEQ ID NO: 38274 - DNA, 664 bp, Zea mays
  misc_feature: Ceres CLONE 1426136-F
  misc_feature: Encodes the peptide sequence at SEQ ID NO. 38275
gcggtggcggccgctctagaactagtggatcccccgggctgcaggaattcgcacgagaccattacctagaacatcctaatcgaaaaattctctcccaccacgctggctcgatcccctgcgaccgatctaatggttctaggacaaactcctacctcttcggctcccgtcgttcagtgccttcccagctggacttagaggcctaatctctactttggaccatgatggccccattgctgcccctgcttgccgtctaggaccagctccctctctccgcaacatacaacatatgcgcaggctccttcgtcggctggcgacgacagctcgctactgaaccaggtgagcgagctcacgtagggcttgcctcttatgcccacccaaaaagagaagctcgcggtgttcctccgccagagcgcggcgatgacctaccccgagctgcaggcgaccaaaacccgggacctcgtgctgctctctgtcggacagcgacaaagtagcgttctcgttcactgctggggttcagatataactcggtggctgctgggcttaggagccaatccgaggtaaacgttccgactcctcgtcctagatccgctggaggtggagatactaccaagagagactagcctgtaccggaaggacacgctccgatctctggtgaacattgcgg

SEQ ID NO: 38275 - protein, 64 aa, Zea mays
  misc_feature: Ceres CLONE 1426136-F
MPTQKEKLAVFLRQSAAMTYPELQATKTRDLVLLSVGQRQSSVLVHCWGSDITRWLLGLGANPR

SEQ ID NO: 38276 - DNA, 665 bp, Zea mays
  misc_feature: Ceres CLONE 1426138-F
  misc_feature: Encodes the peptide sequence at SEQ ID NO. 38277
  misc_feature (324)..(324): n is a, c, t, g, unknown, or other
  misc_feature (381)..(381): n is a, c, t, g, unknown, or other
ggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttnactgctcgagcacggcatccagcctgatgggcaagtgcctggagataggacggcggnacatcacgatgatgccttcagcaccttcttcagccagactgttgctgggaaccacgtccccgtgcattctccgtgattaagaccccctggatcaatgagggggccattgaacttaccgccagttttccacccggaaaccccctctggggcaggggaaaccccaaaaaaattcccccggggccccaaaaaatttcaaagaaaattttttattggtctttaacattcccaaaatttgggaaaaaccccccccccccccggggtcccgggttccacacccgcggggg

SEQ ID NO: 38277 - protein, 67 aa, Zea mays
  misc_feature: Ceres CLONE 1426138-F
  misc_feature (24)..(24): Xaa is any aa, unknown, or other
  misc_feature (43)..(43): Xaa is any aa, unknown, or other
MRECISVHIGQAGIQVGNACWELXLLEHGIQPDGQVPGDRTAXHHDDAFSTFFSQTVAGNHVPVHSP

SEQ ID NO: 38278 - DNA, 672 bp, Zea mays
  misc_feature: Ceres CLONE 1426144-F
  misc_feature: Encodes the peptide sequence at SEQ ID NO. 38279
ggagctccccgcggtggcggccgctctagaactagtggatcccccgggctgcaggaattcgcacgagaccattacctagaacatcctaatcgaaaaatcacacggcgccaccgcgtggttcgttaggaaaggaaatcgattcccccgcatcagatctcttgggtgctagagaaatataaggcgccgcctcctcctcattcggtgaaaggggggcggtaagggttgggagatctcttgactcacgacacgagcatcaaaattcgtcgagggccgctggatgctgcgagagagtccgggccttcgagggatcatgaaaattgaatgttctaatggagtccaagggtggcaagaagaactctagcactattcgatcctccctgatgtacgaggctccccttggctacagcagcaaggatatccgccctgaatgcggcatcaagaagttctccgctgcttaatccaactgcgcgaggaagccatcctgatatctctgtcgtcatccccatcctaggagcgtagaaaccacctgcattttcattttgatctccctaatccgtccggctagctgctttgccgtgaccaaaagatatcagagaccgcttcccgtcttcctcccgtggctgtctgtcatctggctctgagacgaaggcagaccagcaagttgctgctgcg

SEQ ID NO: 38279 - protein, 42 aa, Zea mays
  misc_feature: Ceres CLONE 1426144-F
  misc_feature (1)..(43): Pfam Name: AdoMetDC_leader Pfam Description: S-adenosyl-l-methionine decarboxylase leader peptide
MESKGGKKNSSTIRSSLMYEAPLGYSSKDIRPECGIKKFSAA

SEQ ID NO: 38280 - DNA, 655 bp, Zea mays
  misc_feature: Ceres CLONE 1426150-F
  misc_feature: Translation starting site: 244
aaagctggagctccccgcggtggcggccgctctagaactagtggatcccccgggctgcaggaattcgcacgagaccattacctagaacatcctaatcgaaaaactctttgcttctactcccactcctactctcactttcaactctcagggtcccactccccggataccggctaccctacccatcaaaaacaaatagccactcctcacctcccccgacctccggtacatgtcatggggctccccatgtcgtccccactcgacctcaactacataagcctctcgccggcggcggctgccgcaactgcccacgacaacctgaacggtatccagctccgccttggtctgccggggtccggttcatcagaccaacgtgttgtggcagccacctcaaccaccctggacctgctcccagctaacggcgcctagctgggattatctgacgaggcgccgactacatcgcccggatgcagctgcagtgagagaaaagaatgtatcgtgatcaccatgacgacaagaaggttagctcgacgacgcagccggtctcataagctcacgtagtgggatggccagcaatccgaagctaccggcagatgacgatgtctaccacccatctgaagggctgcaacgagaatgctgacgcctagcaggaccaagg

SEQ ID NO: 38281 - DNA, 651 bp, Zea mays
  misc_feature: Ceres CLONE 1426155-F
  misc_feature: Encodes the peptide sequence at SEQ ID NO. 38282
  misc_feature (343)..(343): n is a, c, t, g, unknown, or other
  misc_feature (417)..(417): n is a, c, t, g, unknown, or other
tggagctccccgcggtggcggccgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctactttccccaaatcagctgctcctggctctnaagttttaagcccaatgatggttgttgtaagagcaatatccgaggaatgtggccccccaggggcttccatttgntcctccaaggtaaaaaggggcattccattgccggaattcgctaatgaaaagggttatgggaggggggaaatttccaaaagcccctgcccccgctgggggctgaattttttgggggaccatgggcccccgccccttaaatattttaaaacaatctcagagcggggaaaattttttataaacccgaaacccccccaaaagggcccctcttaagaaatatggtaaaacccccccccc

SEQ ID NO: 38282 - protein, 146 aa, Zea mays
  misc_feature: Ceres CLONE 1426155-F
  misc_feature (53)..(53): Xaa is any aa, unknown, or other
  misc_feature (77)..(77): Xaa is any aa, unknown, or other
MTASAAAGVQMVAARPCISASPGILTARVAVSRTDCMLSTTATFPKSAAPGSXVLSPMMVVVRAISEECGPPGASIXSSKVKRGIPLPEFANEKGYGRGEISKSPCPRWGLNFLGDHGPPPLKYFKTISERGKFFINPKPPQKGPS

SEQ ID NO: 38283 - DNA, 606 bp, Zea mays
  misc_feature: Ceres CLONE 1426159-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (311)..(311): n is a, c, t, g, unknown, or other
  misc_feature (312)..(312): n is a, c, t, g, unknown, or other
  misc_feature (351)..(351): n is a, c, t, g, unknown, or other
  misc_feature (376)..(376): n is a, c, t, g, unknown, or other
  misc_feature (377)..(377): n is a, c, t, g, unknown, or other
  misc_feature (531)..(531): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttcaaactgggactccaccgcggtggcggccgctctagaactagtggatcccccgggctgcaggaattcgcacgagaccattacctagaacatcctaatcgaaatcgtctctttgctcgcatctggcctcaagcccctcaggcctcagctcaccaccacgaaccaaccgacagaaagaggtgacgaaatgggcgagctctcagtnngctggcgaataaccccggcctgcccctgaaacccggccnttgcggggaaagggcaaaagggggnntcgtccaaaagtttttccgggggggggctcaaaaagggcctataagtgtccccccccgggggggccccccccaagagaaaccccaaaaggggcgcccgcggttccccccccttgtgggtccccccaaaaaaaaaatttttttgggagaatttancccaacacggnnnnnnnnnnnnnccccccccccccctctttttttgggggggaaaaaaaaaaaaacccccccccc

SEQ ID NO: 38284 - DNA, 625 bp, Zea mays
  misc_feature: Ceres CLONE 1426160-F
  misc_feature (188)..(188): n is a, c, t, g, unknown, or other
  misc_feature (275)..(275): n is a, c, t, g, unknown, or other
  misc_feature (313)..(313): n is a, c, t, g, unknown, or other
aaagctggagctccccgcggtggcggccgctctagaactagtggatcccccgggctgcaggaattcgcacgagaccattacctagaacatcctaatcgaaaaattcccctcccgaagtcccgatcctgtcctcaaatcccattgctctatcttctctagcggcgagtcgaggcggggaagacgagctnagcgcgaggatgttgtgggtagataagtaccgggccgaaaaaccctagacaggtcaccgtgcacgaccaggttgctcagaacctcangaaagtttgttgtcggaccaggaatgccccgcacttgnttgttcattgggcccttcggggttcccggaaagaaaaccctttattctaacggcctcatcaaccaaaaagttcccggccccgggccccgaaaaaaggtttaaccttgggaaaccaagaacttgtgaaaattctttttcgggaacaggggcctttttggaaaaaaaatttggcgaatattttccagaggccccccccggtgtgggaaagagccccccccggggttgtggggttttttcggagacgggtttttttttttctggggggccccccaaaaaagagggggaaaaaaaaggcccctttttttcccccaa

SEQ ID NO: 38285 - DNA, 600 bp, Zea mays
  misc_feature: Ceres CLONE 1426161-F
  misc_feature: Translation starting site: 265
  misc_feature (50)..(50): n is a, c, t, g, unknown, or other
  misc_feature (248)..(248): n is a, c, t, g, unknown, or other
  misc_feature (256)..(256): n is a, c, t, g, unknown, or other
  misc_feature (543)..(543): n is a, c, t, g, unknown, or other
ctggagctccaccgcggtgggcggccgctctagaactagtggatcccccngggctgcaggaattcgcacgagaccattacctagaacatcctaatcgaaaaagccgcatcccttctttcattcgccgccgccgcctgctctctgctgccgtcgccatggggaagaggcctgcgagatgctatcgcccagatcagaacagccataccccaagtcccagtactgccgtggtgtccctgacccaagatcangatctacnatgttggcatgaagagaaaggtgttgatgagtcccctactgtgtgcaccttgctcttgggagaaggagaatgtctccagtgaagctcttgaggctgccgtaattcctgcaacaatacatggaccaatctgcggaaaggtgcccttcaccctccgggtccgggtcccccccttccgttgctttcatttaacaaaatgctttctggtgctgggggctaatagcccccaaatggaaaagggggggccctttgtgaaccccaggggccctttgttaagggggaacttttgnaagggctcctttttttttttaataaaggaaacaaatttgtccaatcccccgaaaccc

SEQ ID NO: 38286 - DNA, 700 bp, Zea mays
  misc_feature: Ceres CLONE 1426172-F
  misc_feature: Encodes the peptide sequence at SEQ ID NO. 38287
  misc_feature (257)..(257): n is a, c, t, g, unknown, or other
  misc_feature (310)..(310): n is a, c, t, g, unknown, or other
ggagctccccgcggtggcggccgctctagaactagtggatcccccgggctgcaggaattcgcacgagaccattacctagaacatcctaatcgaaaagattgggtccaacaccagccgccgccatgtcgaagcgaggcaggggaggttcggcggggaacaagttccgcatgtcgctgggtctgccggttgccgcgacggtgaactgcgcggacaacacgggcgccaagaacctctacatcatctccgtcaagggcatncaggggcgcctcaaccgcctcccgtccgcctgcgttggcgacatggtcatggnccacgtcaagaaggggaagcccgacctcaggaagaagtgatgcccgccgtcatttccggcagggcaaggcgtggcccccaaggaacggtgttaccttgatcttccaaaaaaatggttggggggttttgaaatcacaggggggaataaagggcccctttccggggccctttgggaagggggggggtatttttgccccaaattttaggccgaaaaaacccctttttgaaaaagtggggagaaattccacaccccttaaaacccctttttaaccccccaaaaaagttttgttgtttaaggcccccctttttttttccccccccttttttttaaaaaaaaatttttttttccccgggggttttatttttgggggggccccaaaatttgccccca

SEQ ID NO: 38287 - protein, 75 aa, Zea mays
  misc_feature: Ceres CLONE 1426172-F
  misc_feature (45)..(45): Xaa is any aa, unknown, or other
  misc_feature (63)..(63): Xaa is any aa, unknown, or other
MSKRGRGGSAGNKFRMSLGLPVAATVNCADNTGAKNLYIISVKGXQGRLNRLPSACVGDMVMXHVKKGKPDLRKK

SEQ ID NO: 38288 - DNA, 649 bp, Zea mays
  misc_feature: Ceres CLONE 1426176-F
  misc_feature: Encodes the peptide sequence at SEQ ID NO. 38289
aagctggagctccccgcggtggcggccgctctagaactagtggatcccccgggctgcaggaattcgcacgagaccattacctagaacatcctaatcgaaaaattccactccatcagtgggcagcgctctgctctcctccactcactcactccccttgcccccatccatccgctagccactagctccagcaggctcgccgccgacactccactagtgctctgctctctccgctccactcacaaactcccctcgctccccccccccccccccaatcggcgatggatctgctgctgcggcggcagctgctggccgtggtggccacggcggcggtgctggccttgtgcgccttcacggcggaggaggggttcgacatcctgcagatcctggggaagcacgacgagttctcgcagttctgcaagctgctcaacgagacacacctggccggcgacatcaaccgcgaccgcacaatcaccgtgctggccgtggccaacggtaacatgggccacctcgcacgcggccactactcggtcggcagcatcagccacatcctcgagctgcacgtcgtcgccgactactacgacgactagaagctcaagcagctgtcgcacgccgccaccgccgcgtccaccttgttccagcgatccggatt

SEQ ID NO: 38289 - protein, 102 aa, Zea mays
  misc_feature: Ceres CLONE 1426176-F
MDLLLRRQLLAVVATAAVLALCAFTAEEGFDILQILGKHDEFSQFCKLLNETHLAGDINRDRTITVLAVANGNMGHLARGHYSVGSISHILELHVVADYYDD

SEQ ID NO: 38290 - DNA, 651 bp, Zea mays
  misc_feature: Ceres CLONE 1426182-F
  misc_feature: Encodes the peptide sequence at SEQ ID NO. 38291
aagctggagctccccgcggtggcggccgctctataactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgctgggcgccgaggaccagctgcggcagctgcgcgcgcgccgccgcgaggacgcccgcgccaacgcccgcggccccgagatcttcgcgggccaccgcgccgcctggatggaggccgaacgcccgcctgaagcccgcgccgccgccgccgcggaagaggccgccttcctccgcgcgcacctcgccgaacccgaagccccacccgctggcctgtccgcccgccccaaacgacttgagcgccaagccgccaaacgggatgaactggtctc

SEQ ID NO: 38291 - protein, 156 aa, Zea mays
  misc_feature: Ceres CLONE 1426182-F
MAAESARPPSPPRDSGCPAGAGDSTSSQLTATYLGVSFALFLATLPSGTAARHVASLQSRGRLLASRLLGAEDQLRQLRARRREDARANARGPEIFAGHRAAWMEAERPPEARAAAAAEEAAFLRAHLAEPEAPPAGLSARPKRLERQAAKRDELV

SEQ ID NO: 38292 - DNA, 664 bp, Zea mays
  misc_feature: Ceres CLONE 1426184-F
  misc_feature: Encodes the peptide sequence at SEQ ID NO. 38293
  misc_feature (489)..(489): n is a, c, t, g, unknown, or other
  misc_feature (568)..(568): n is a, c, t, g, unknown, or other
  misc_feature (622)..(622): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttcccgcaggcgcagtgcccgatcgtcgagcgcctcacaaactccctcatgatgcacgggcgcaacaacggcaagaaggtcatggctgtccgcatcatcaagcataccctggagatcatttcactgctcnacgatgccaacccatcccagtcgtcgtcgacgcgatcatcaacagtggaccccgtgagatgcccacccgtatggtccgnctgtggttggaaggaggcaggcgtggatatctcaccctggaagagggtgaacangncatctaccctctcaccactggtgccagggagagtgctttc

SEQ ID NO: 38293 - protein, 156 aa, Zea mays
  misc_feature: Ceres CLONE 1426184-F
  misc_feature (44)..(114): Pfam Name: Ribosomal_S7 Pfam Description: Ribosomal protein S7p/S5e
  misc_feature (99)..(99): Xaa is any aa, unknown, or other
  misc_feature (125)..(125): Xaa is any aa, unknown, or other
  misc_feature (143)..(143): Xaa is any aa, unknown, or other
  misc_feature (144)..(144): Xaa is any aa, unknown, or other
MAEVEQQQDTPKLFNRWTFDDVQVNDISLNDYLAVNATKHAMYLPHTAGRYSKKRFPQAQCPIVERLTNSLMMHGRNNGKKVMAVRIIKHTLEIISLLXDANPSQSSSTRSSTVDPVRCPPVWSXCGWKEAGVDISPWKRVNXXSTLSPLVPGRVL

SEQ ID NO: 38294 - DNA, 615 bp, Zea mays
  misc_feature: Ceres CLONE 1426187-F
tggagctccccgcggtggcggccgctctagaactagtggatcccccgggctgcaggaattcgcacgagaccattacctagaacatcctaatcgaaaaagaccacaaacacaagtcgtcgtaggcagcgagcgtctctcctctcccacgcatcgcgccaaggaagagagagagatcgccgctcccctttctcggcgtcgtggtgcgggtgccctccctcctcgagcgagatctgtctggtcacaaatctatctgacaaatggtgaaaatctgctgcatcggggctggcatgtcgggggccaaacctggcccgcaattgcccccaaggccccaaatttgaggcgcccccctttaaacctccaacccccatttggggccgggaaaaggaacccctggccaacttcaaacccgggttccaaaagattttggaaaaaaggcggggggggggaacccttcttctccccctattttggaaaaacccccccctaagagggattatatttttgtcccgggggaacccccccccaaaaccctggggttttaaaattctagatccccccccccccccccgggggagcccccccccccaatgggggggttcccccaccgacaaaaaa

SEQ ID NO: 38295 - DNA, 594 bp, Zea mays
  misc_feature: Ceres CLONE 1426190-F
  misc_feature: Encodes the peptide sequence at SEQ ID NO. 38296
  misc_feature (203)..(203): n is a, c, t, g, unknown, or other
  misc_feature (228)..(228): n is a, c, t, g, unknown, or other
  misc_feature (234)..(234): n is a, c, t, g, unknown, or other
  misc_feature (240)..(240): n is a, c, t, g, unknown, or other
tcaccgcggtggcggccgctctagaactagtggatcccccgggctgcaggaattcgcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgncagtgccatcgcgtccttctccgtnggcgcngcagcngctgctgctctgcgcgtcaggcggccatgcgctcgcgcttgcgcttgggccccctcgcagcgaccgcagcaaggggcactccgtcagcttccaggcttggccgctcattgccaccacaagctcttctgggggccccggagtcggaatgccccgggggggggggggccggcccccggaaatttcattggccctcccccccccgggaaaggaaaaatctttccccgggaaaaaagaatgaaggaaattcctccggggaagacccgtttttaaacaacttccctccccttttggccccctttcaccccgagaatttgaaattcccccccttttttaaaaaaccacaaggggggattc

SEQ ID NO: 38296 - protein, 107 aa, Zea mays
  misc_feature: Ceres CLONE 1426190-F
  misc_feature (6)..(6): Xaa is any aa, unknown, or other
MATGSXSAIASFSVGAAAAAALRVRRPCARACAWAPSQRPQQGALRQLPGLAAHCHHKLFWGPRSRNAPGGGGPAPGNFIGPPPPGKGKIFPREKRMKEIPPGKTRF

SEQ ID NO: 38297 - DNA, 761 bp, Zea mays
  misc_feature: Ceres CLONE 1426192-F
  misc_feature: Encodes the peptide sequence at SEQ ID NO. 38298
  misc_feature (377)..(377): n is a, c, t, g, unknown, or other
  misc_feature (533)..(533): n is a, c, t, g, unknown, or other
  misc_feature (534)..(534): n is a, c, t, g, unknown, or other
  misc_feature (749)..(749): n is a, c, t, g, unknown, or other
ggagctccccgcggtggcggccgctctagaactagtggatcccccgggctgcaggaattcgcacgagaccattacctagaacatcctaatcgaaaaacattccccgagagaggacacacaccaaagctaaagagcgaaaatggcagcgacaactctctccaccgcaagaataatcctttcctcatcatctcccactctcaccgccgcccatcccttcttctcccgacccaccacactcgaattcccatctcgcttcggtctttcttcgtcctcctccacactaacccaccgcggcacccacctccgccccctcgccgccgtcgaatccccggagaaaatcgagaaaatcggatccgagatctcgtccctcacccccncacaagcccggatcctcgtcgactacctccaggacaaagtaggcgtcacgcctctctccttggctcccgccccagcggctgtcgctgctcctggaaacggcggcggccccgccgggcgtggtggaggaagacacggacctccagggggtggataannaggggccaagcaccctccccccacacggtcgattaaagagccgatgaggtctcttccactttatgcctctatcacagggcttcttgaaggacctgatgtaagcaaatggttgtcgctacacttgcggacccaggaatgaatgctttagatgaagtcatacagagcatcactgatagacgttggaggagcagaccaagcctgatggtaaatgtccngacgcctgccat

SEQ ID NO: 38298 - protein, 130 aa, Zea mays
  misc_feature: Ceres CLONE 1426192-F
  misc_feature (80)..(80): Xaa is any aa, unknown, or other
MAATTLSTARIILSSSSPTLTAAHPFFSRPTTLEFPSRFGLSSSSSTLTHRGTHLRPLAAVESPEKIEKIGSEISSLTPXQARILVDYLQDKVGVTPLSLAPAPAAVAAPGNGGGPAGRGGGRHGPPGGG

SEQ ID NO: 38299 - DNA, 652 bp, Zea mays
  misc_feature: Ceres CLONE 1426195-F
  misc_feature: Encodes the peptide sequence at SEQ ID NO. 38300
  misc_feature (587)..(587): n is a, c, t, g, unknown, or other
aaagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacaaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaagggtgggtgaagtggctcantggcgtcatcgacaatgccctgtaccccgtcctcttcctggactacctcaagtccgccgtgcctg

SEQ ID NO: 38300 - protein, 137 aa, Zea mays
  misc_feature: Ceres CLONE 1426195-F
  misc_feature (116)..(116): Xaa is any aa, unknown, or other
MGECRTEYRGLPDANGEDAGTVPAALRKVSIVPLVFLIFYKVSGGPFGIEDSVGAAGPLLAIVGFLVLPVIWSIPEALITAELGTMFPENGGYVVWVASALGPYWGFQQGWVKWLXGVIDNALYPVLFLDYLKSAVP

SEQ ID NO: 38301 - DNA, 646 bp, Zea mays
  misc_feature: Ceres CLONE 1426201-F
  misc_feature: Encodes the peptide sequence at SEQ ID NO. 38302
tctgaactagtggatcccccgggctgcaggaattcgcacgagaccattacctagaacatcctaatcgaaaaaattattgcctctctttcttgctcgccacagcttcgtcaaagacacgcggaaaagaagaggaagggggaggcgactcgaccgaggcccggtttcgatctctggtcctccgattgcgtccagatctaccagcaatggcatcatcttcggacccatggatgaaggaatacaatgaagcatccagacttgctgatgacatcagttccatgattgccgacagagggtctcttccacaatcaggcccagaaattatgcggcatacttcagccattcggagaaaaataactattcttggtactagactggatagcttggagtcattgtttggcagaattcctccaaagtcaatcactgacaaggagatgcataaacgccaagacatgctttccagtttgaagtctaaagccaagcagatggcgacaagtttcaacatggtcaacttccctaacagggaggatctgcttggtcaaagtaaaatgcccaatgacatgaacagaatttgctgggttagataaaccaaggaattgtttgggctttcgaaggggcatttttgaaaagcacctagatgaaggttctc

SEQ ID NO: 38302 - protein, 126 aa, Zea mays
  misc_feature: Ceres CLONE 1426201-F
MASSSDPWMKEYNEASRLADDISSMIADRGSLPQSGPEIMRHTSAIRRKITILGTRLDSLESLFGRIPPKSITDKEMHKRQDMLSSLKSKAKQMATSFNMVNFPNREDLLGQSKMPNDMNRICWVR

SEQ ID NO: 38303 - DNA, 634 bp, Zea mays
  misc_feature: Ceres CLONE 1426211-F
  misc_feature: Encodes the peptide sequence at SEQ ID NO. 38304
gcggtggcggccgctctagaactagtggatcccccgggctgcaggaattcgcacgagaccattacctagaacatcctaatcgaaaagccaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgccccgcgccccctgaaaccatacggacacgggtgggcccaacccacaccaagatgttctccgccattaccgggcgagctaacctattaagggtccataaaaaaaa

SEQ ID NO: 38304 - protein, 130 aa, Zea mays
  misc_feature: Ceres CLONE 1426211-F
MATHRHCLPLLLVAAALALAAVPARAALGGGRGPLLGGWNPIPDVSDSHIQELGGWALGQAKHQKLAADGLRFRRVVRGEQQVVSGMNYRLYVDAADPAGRTVPYVAVVYEQVWTRTRQLASFNPVPRAP

SEQ ID NO: 38305 - DNA, 667 bp, Zea mays
  misc_feature: Ceres CLONE 1426242-F
  misc_feature: Encodes the peptide sequence at SEQ ID NO. 38306
tccccgcggtggcggccgctttagaactagtggatcccccgggctgcaggaattcgcacgagaccattacctagaacatcctaatcgaaaattctcttgatcgctttgtcacttgaatccgtgcctgctctaacagagagcggatcagcggagacacgacgacgacgacgaagccaggctcaggctctgcaatggagcaggagccgcaccggcccatggagctgcccccgggcttccgcttccacccgaccgacgaggagctcatcacgcactacctggcccgcaaggccgccgacgcccgcttcgccgcgctcgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggctccaagaagacgctcgtcttctacacggggagggcgcctaggggcgagaagtccggatgggtcatgcacgagtaccgcctccacgccaagctccatggccacggccacggccaaggcgcagccgtcgtcgtcgtccccaagcaggccgc

SEQ ID NO: 38306 - protein, 158 aa, Zea mays
  misc_feature: Ceres CLONE 1426242-F
  misc_feature (11)..(137): Pfam Name: NAM Pfam Description: No apical meristem (NAM) protein
MEQEPHRPMELPPGFRFHPTDEELITHYLARKAADARFAALAVAEADLNKCEPWDLPSLARMGEKEWYFFCLKDRKYPTGLRTNRATEAGYWKATGKDRDVFRGKALVGSKKTLVFYTGRAPRGEKSGWVMHEYRLHAKLHGHGHGQGAAVVVVPKQA

SEQ ID NO: 38307 - DNA, 602 bp, Zea mays
  misc_feature: Ceres CLONE 1426244-F
  misc_feature: Encodes the peptide sequence at SEQ ID NO. 38308
aaagctggagctccccgcggtggcggccgctctagaactggtggatcccccgggctgcaggaattcgcacgagaccattacctagaacatcttaatcgaaaaatctatcgcactcgtagtcgtagctcaagcatcaccggcaggagctctgggcagcgtgcgcacgtggggtacctagctcgctctgctagcctaccatggctgatcaccaccgggatgcgacgggaggtggcgggggctacggcgacctccatcgcgggggcggcatgcacggccaggcccatcatcagcacaagcagggcgccatgatgacggcgctcaaggccgcgacggccgcgaaccttcggcgggtctatgctggtgctgtccgggctgatcctggccggcaccgtgatcgcactcacggtggccacccccgtgctggtgatcttcaccccagtgctggtgccggccgccatcgcgctggcactcatggcggccggatacgacacctccggcggcctcgacgtcgctgagctgtccgtgttctcctggatgtacaagtacctgacgggcaagcacccgccgggagccgaccatctggaccacgccaaggcgaggct

SEQ ID NO: 38308 - protein, 82 aa, Zea mays
  misc_feature: Ceres CLONE 1426244-F
  misc_feature (1)..(82): Pfam Name: Oleosin Pfam Description: Oleosin
MLVLSGLILAGTVIALTVATPVLVIFTPVLVPAAIALALMAAGYDTSGGLDVAELSVFSWMYKYLTGKHPPGADHLDHAKAR

SEQ ID NO: 38309 - DNA, 664 bp, Zea mays
  misc_feature: Ceres CLONE 1426264-F
  misc_feature: SWISSPROT Homolog: EC 3.1.2.15 Ubiquitin thiolesterase
ggagctccccgcggtggcggccgctctagaactagtggatcccccgggctgcaggaattcgcacgagaccattacctagaacatcctaatcgaaaatctctccgatcggatgaaaacttcaacagattggtatgagctcctgaacgttgtagtttatcttcgcttttcgttatcttcttcgattccgtctcgaattttgaattgatgattctccttatttcatcggaagcatcgaggatttggagattacgaatcttttgatccgatcaaacgttggagcctcttcagataaagtagaatgagtagaaaaagagcagaaaatgacactgagtcaggatcaggaacagccactccggtggatagattcgggttcctgaagcaagaacatgccagcaaggctagaacaacaacaacatcatcatccactgaccaggacagagaggagagaaaagtgaggaaatggaggaagatgattggggttggaggcagtgactggaagcattacgttagaaggaaacctaacgttgtcaagaggcgtatacgcaaagggatccctgattgtttaagaggtcttgtttggcagttgatctctggaagccgcgaccttttgcttatgaatcctggtgtttatgagcaactggtgatttatgagacatcggcatca

SEQ ID NO: 38310 - DNA, 655 bp, Zea mays
  misc_feature: Ceres CLONE 1426265-F
  misc_feature: Encodes the peptide sequence at SEQ ID NO. 38311
agagctggagctccccgcggtggcggccgctctagaactagtggatcccccgggctgcaggaattcgcacgagaccattacctagaacatcctaatcgaaaagcaggcacccagacccagcagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgagtggcactccgcggggacgttcgacgtgtcgtcgaggaccggcgggcccttcggtactatgaagtgcccggcggaactggctcacggcgccaacgcggggctggacatcgcggtgcggctgctcgagcccatcaaggaggagttccccaccctctcctatgccgatttctaccagcttgacggagttgtgggcctcgaggtcaccggggggcctgagatccccttaccacccggtagggaggacaagccgtcaccgcccactgagggccgtcttcctgatgccaccgaggggatctgaccactgacgcaagtctttggcaagcagatcgttttgagtgat

SEQ ID NO: 38311 - protein, 138 aa, Zea mays
  misc_feature: Ceres CLONE 1426265-F
  misc_feature (19)..(139): Pfam Name: peroxidase Pfam Description: Peroxidase
  misc_feature: SWISSPROT Homolog: EC 1.11.1.11 L-ascorbate peroxidase
MAKNYPTVSAEYSEAVEKARRKLRALIAEKSCAPLMLRLEWHSAGTFDVSSRTGGPFGTMKCPAELAHGANAGLDIAVRLLEPIKEEFPTLSYADFYQLDGVVGLEVTGGPEIPLPPGREDKPSPPTEGRLPDATEGI

SEQ ID NO: 38312 - DNA, 597 bp, Zea mays
  misc_feature: Ceres CLONE 1426267-F
  misc_feature (247)..(247): n is a, c, t, g, unknown, or other
  misc_feature (266)..(266): n is a, c, t, g, unknown, or other
  misc_feature (267)..(267): n is a, c, t, g, unknown, or other
  misc_feature (274)..(274): n is a, c, t, g, unknown, or other
  misc_feature (275)..(275): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (357)..(357): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (431)..(431): n is a, c, t, g, unknown, or other
  misc_feature (433)..(433): n is a, c, t, g, unknown, or other
  misc_feature (437)..(437): n is a, c, t, g, unknown, or other
  misc_feature (449)..(449): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (460)..(460): n is a, c, t, g, unknown, or other
  misc_feature (461)..(461): n is a, c, t, g, unknown, or other
  misc_feature (464)..(464): n is a, c, t, g, unknown, or other
  misc_feature (465)..(465): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (576)..(576): n is a, c, t, g, unknown, or other
  misc_feature (588)..(588): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgaaagacggcagcaatggcggaccgtgaccgcagcggcatctacgggcggcgcanccacgccacctacggggcnnagcagcnnaggcagccaaggggaaagggaaaaaggcccggggccccccccccccaaaaagggggggggnnnnnnnnnnnnnnnnnnnnanaaaaaaaaaaaannnnnnnnannnnnnnnnnnnnnnnnaaaaaannannnnnnnnnnnnnaaaaaaaaaaaaananaaanaaaggagggggngggnnnnnggnnggnnggggggggggggggggggggnnnnnnaggnnnnngnnnnggggggaggggggggggagnnnnnnnnnagggggggnnnnggnnnnagggnnngggggggggnnnggagagnaagggaggaagnaaaaaaaaa

SEQ ID NO: 38313 - DNA, 677 bp, Zea mays
  misc_feature: Ceres CLONE 1426276-F
  misc_feature (329)..(329): n is a, c, t, g, unknown, or other
  misc_feature (415)..(415): n is a, c, t, g, unknown, or other
aaagctggagctccccgcggtggcggccgctctagaactagtggatcccccgggctgcaggaattcgcacgagaccattacctagaacatcctaatcgaaaaaatgcagcagtagccgtctgcctcctcgctttccctttcgtccgtacgccgccgcctcgcaccgccgacagtcctcagtccagaactccagatcgagcctccctctccccagatcgggtcctaggctacagcagccgccgcatccgtcaccttcacaccgcgtgcgtgctctctctccccctccccctctccgtgcgacgactgggtgggctaccgccgccctacgncaggtgcagagaaactcgccgatatctgcgccggagaagagcgcccacagatcaggcgcttaaaaggcgcgctgaccgtgatgacnatggccggtggcgggggactgaacgggcttcatgaggggggaactgccgcccaaaagcttgttgaaaattctggaccgggttccttctaaatgggccaaggggggcctgggagtctttcaaggggaaccgtgtccggggggaaaaggcccctggttttttgggagaaaaccctgtgggaaaaccccccacctagggcccctctctttagagggatttccttccccttgtttaaaaaaaggccctgtctccccggccaccaaa

SEQ ID NO: 38314 - DNA, 631 bp, Zea mays
  misc_feature: Ceres CLONE 1426287-F
  misc_feature: Encodes the peptide sequence at SEQ ID NO. 38315
aaagctggagctccccgcggtggcggccgctctagaactagtggatcccccgggctgcaggaattcgcacgagaccattacctagaacatcctaatcgaaaaaatatacggttctctcgtgttctgttctcatcttctgttctctggtgtcgcctccctctcacccatgggttctggggcgggggaaactaaggtggggacttacttcctgagcaagtactacaacctgttgaaagaaacccccaatgtcctcaaccagttctacagcaaaaccaacaccatggtccgcctcaacgaccatcaccggaacggacctgctctgccaacaagatgatagacatacactcgctcatcatgtctttaaacttcacccaaattgagatcatgactgtcaattttgtgaactcatggctgcaatggcttgctatttatgtgctctggtctactgcagaccaccgaatactcccaccaaaggaaatttatccagatgttcttccttgcacctcaagagaagggttactttgtcctcaacgattactttcacttcggtgagcaataacatgtgtaccctgcaacagtgattgctcaggaatactacgacagcaatattacacccaacacagttgttgaa

SEQ ID NO: 38315 - protein, 55 aa, Zea mays
  misc_feature: Ceres CLONE 1426287-F
MGSGAGETKVGTYFLSKYYNLLKETPNVLNQFYSKTNTMVRLNDHHRNGPALPTR

SEQ ID NO: 38316 - DNA, 625 bp, Zea mays
  misc_feature: Ceres CLONE 1426293-F
  misc_feature: Translation starting site: 298
  misc_feature: SWISSPROT Homolog: EC 3.4.25.1 Proteasome endopeptidase complex
  misc_feature (335)..(335): n is a, c, t, g, unknown, or other
  misc_feature (338)..(338): n is a, c, t, g, unknown, or other
  misc_feature (342)..(342): n is a, c, t, g, unknown, or other
  misc_feature (347)..(347): n is a, c, t, g, unknown, or other
  misc_feature (395)..(395): n is a, c, t, g, unknown, or other
  misc_feature (397)..(397): n is a, c, t, g, unknown, or other
  misc_feature (402)..(402): n is a, c, t, g, unknown, or other
aaagctggagctccccgcggtggcggccgctctagaactagtggatcccccgggctgcaggaattcgcacgagaccattacctagaacatcctaatcgaaaaaaaaagggtaccggaagcggcgaaagcctcgccccccgccgctctcgcatcgtctccggagcgcacgtcagatcaggtgcgccgcgcccccctcgcctaagctgcgacgaccatccatcgaacaggaaggatgacgggctccatggatctcccggccaagggcgggttcagcttcgacctgtgccgccggaacacatgctggagaagaacgggctcagggtcccgggattcangangacngggancaccatcgtcggcctcgtcttcaggaatggggtgttcttggggcgacncnagggncactgagggcccaatagtgctgatagaactgtgaaaaatcactttaggcaccgaatattaccgctgggaaccagactgctgggaaccggaggcctttaaaaaatgggagtcccaaaataggtttcccgttaaaaaggggccgaaataaaaatttaacgggcctaaaccgagaagccccccctttaaaaaaaaggggagtagggcccccctttttctggggagg

SEQ ID NO: 38317 - DNA, 653 bp, Zea mays
  misc_feature: Ceres CLONE 1426296-F
  misc_feature: Encodes the peptide sequence at SEQ ID NO. 38318
  misc_feature (361)..(361): n is a, c, t, g, unknown, or other
  misc_feature (395)..(395): n is a, c, t, g, unknown, or other
  misc_feature (408)..(408): n is a, c, t, g, unknown, or other
  misc_feature (557)..(557): n is a, c, t, g, unknown, or other
ggggctccccgcggtggcggccgctctagaactagtggatcccccgggctgcaggaattcgcacgagaccattacctagaacatcctaatcgaaaatttttttccccgctctgctctgcacgcccctctcctccctagtccctccccctacccccgcccgtcaaagcgagagcgccgtatcacctgtctctccgtccaccgccgtctcgatccgcgcccaaagatacctttcccccaccccttcctcgcgccgccgttttggtgcgaccatgacggcggagggggaggccaagaacccgtcggccggtggcggaggggataacccccagcaccagcaggctgcgccggcgcgggcgccggnacagggggaagtggcgcagggagctgcattgcangggacgggacaanaccaggaacgggacaaggtggatccaagagggcagggccgccccgggggaaaaggaaaaacgccccgtgcaaaaaatcttggtcttggtcaagtactccgaaggccctcccccccaaggaatccgaaggaaactttcaccaaaccccancccttccagaaaaaaaaagaaaacccctcttggggaaccccacccccggggggggcggggaaaaaacttttccaagcccttgggggttttttgggg

SEQ ID NO: 38318 - protein, 128 aa, Zea mays
  misc_feature: Ceres CLONE 1426296-F
  misc_feature (31)..(31): Xaa is any aa, unknown, or other
  misc_feature (42)..(42): Xaa is any aa, unknown, or other
  misc_feature (47)..(47): Xaa is any aa, unknown, or other
  misc_feature (96)..(96): Xaa is any aa, unknown, or other
MTAEGEAKNPSAGGGGDNPQHQQAAPARAPXQGEVAQGAALXGTGQXQERDKVDPRGQGRPGGKGKTPRAKNLGLGQVLRRPSPPRNPKETFTKPXPFQKKKENPSWGTPPPGGAGKKLFQALGGFLG

SEQ ID NO: 38319 - DNA, 676 bp, Zea mays
  misc_feature: Ceres CLONE 1426298-F
  misc_feature: Encodes the peptide sequence at SEQ ID NO. 38320
caaagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtgccaaggagatccctgatgattattttgtttgtttggttggagacatgattactgaggaagctctaccaacataccagactatgcttaacaccctcgacggtgtcaa

SEQ ID NO: 38320 - protein, 150 aa, Zea mays
  misc_feature: Ceres CLONE 1426298-F
  misc_feature: SWISSPROT Homolog: EC 1.14.19.2 Acyl-[acyl-carrier-protein] desaturase
MALRLHDVALCLSPPLAARRRSGGSFVAVASMTSAAVSTRVENKKPFAPPREVHVQVTHSMPSHKIEIFKSLDDWARDNILTHLKPVEKCWQPQDFLPDPASEGFHDEVKELRERAKEIPDDYFVCLVGDMITEEALPTYQTMLNTLDGV

SEQ ID NO: 38321 - DNA, 637 bp, Zea mays
  misc_feature: Ceres CLONE 1426303-F
  misc_feature: Encodes the peptide sequence at SEQ ID NO. 38322
aaagctggagctccccgcggtggcggccgctctagaactagtggatcccccgggctgcaggaattcgcacgagaccattacctaaaacatcctaatcgaaaaagtttcccggctccctcgctcacgcgccgcggcatcactccggccggctggccagtcacccactcttcccacccacaccgccgctgcctttccttccacggcgaactctccgcgggcgacatccagactggcaacggcattccaataaaagaatgcgcccctgctctggccaactctctccaccagcattccccgttccgctaaaccctagccgcctccggcgcgtagtacattcgccatcagagacgacgctcggcggccctgaagaaggatgacctacgtcaacccagacccccagccgctcgccgccgctacggcggatgattccgcaacccagcatcaaactgcggtgaccgccgcgccgcactcgacgcgaggcgctctcgggttttttgcgacggcggagccgaagcagggcgcgaccatggtggcgccatcgtccccgcagggcgttcccgggttcgcggtcgtgccccacgcccagggggtcgagaaatagcgccccccgagtcaccgcaaggccctcccgggtttt

SEQ ID NO: 38322 - protein, 75 aa, Zea mays
  misc_feature: Ceres CLONE 1426303-F
MTYVNPDPQPLAAATADDSATQHQTAVTAAPHSTRGALGFFATAEPKQGATMVAPSSPQGVPGFAVVPHAQGVEK

SEQ ID NO: 38323 - DNA, 863 bp, Zea mays
  misc_feature: Ceres CLONE 1426311-F
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (47)..(47): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (748)..(748): n is a, c, t, g, unknown, or other
tttttggtgggggggggggtttgggggtggnnnnnnctttgtggggnggggggnnnnnncagggtggggctccccgcgggggcggccgctctagaatagtggatcccccggggtgcaggaattcgcacgagagcattacctagaagatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgcgggcgtgctgctggtcgtagcacccacggccgggggcggaggacggagtggtcggaacggggaccgcaaggaggacctgggggtggtgcaagcaaggcgtggcgaggtggcagtacggaaaagggaccccccgcggggaagggggggaatgcaaaaaaccaaggggcctttaaacccccccccaacaaaacttaaaccccggggaaaaggaagggggaaaagggcgggggggggaaaccccataaagtttctcccgcctccccgcggaaaggggggcaaaggtgccccggggcccccagggggccgggcgcccgcccccccaaggggggccacgcgccgtgtggagaaacccccccagagtgggtccatgggggcgggggaggccccccccccccgggaagagggggggccctccaatgtgggagacnacaaacacaggttctgcggggcaaagacaaaaggcggcccgaaaagtgcgcgggggagagggggggggacgccccgccccccccactgagaataagtgggtagaaaaaggacccc

SEQ ID NO: 38324 - DNA, 855 bp, Zea mays
  misc_feature: Ceres CLONE 1426315-F
  misc_feature: Encodes the peptide sequence at SEQ ID NO. 38325
  misc_feature (13)..(13): n is a, c, t, g, unknown, or other
  misc_feature (14)..(14): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (438)..(438): n is a, c, t, g, unknown, or other
  misc_feature (776)..(776): n is a, c, t, g, unknown, or other
  misc_feature (835)..(835): n is a, c, t, g, unknown, or other
gtgtttttgcccnnccgcgcctcgcttccctccccaaannaaaanaannnccaaactgggactccccgcggtggcggccgctctacaatagtggatcccccgggctgcaggaattcgcacgagaccattacctagaacatcctaatcgaaaacatcaccaccactgggtcttcagaccattagctttatctactccagagcgcagaagaacccgatcgacaccatgagggtgttgctcgttgccctcgctctcctggctctcgctgccagcgccacctccacgcatacaagcggcgggtgcggctgccagccaccgccgccggttcatctaccgccgccggtggatctgccacctccggttcacgtgccagctccggtgcatctcccacagaccgtccacctgccggcgggggtcggtgtggtaagttttttttcacnccgggagccgggggcgcgctgggggcgcgcgggcgcggggggggatgatccgaccgcgaggcgagggcgggggtggcgcctgcgcccgcgcgggcgacagtcgcgggcccggtgcgggtggtggcgatcggtgctgggggggcgatggggagccgcgcgcgggggcgacggctctcgcggtcgggggtgcgcgggggcggcgggtgggcgggagcgcggggcggtcgggggctcaccgggcggggccggcggcgaggcgacgcggcaccgcgcgccaccacacgccccgacgcattgctctgcaggaagcgcggcgatcgcccggcgtccgtcgctgncgcgcacgtggtcggtgagcggagcgcgcgaacaggcgcgcgcgcggagctcgcgctgncggtgtgtggtcgggcgcgg

SEQ ID NO: 38325 - protein, 210 aa, Zea mays
  misc_feature: Ceres CLONE 1426315-F
  misc_feature (72)..(72): Xaa is any aa, unknown, or other
  misc_feature (185)..(185): Xaa is any aa, unknown, or other
  misc_feature (204)..(204): Xaa is any aa, unknown, or other
MRVLLVALALLALAASATSTHTSGGCGCQPPPPVHLPPPVDLPPPVHVPAPVHLPQTVHLPAGVGVVSFFSXREPGARWGRAGAGGDDPTARRGRGWRLRPRGRQSRARCGWWRSVLGGRWGAARGGDGSRGRGCAGAAGGRERGAVGGSPGGAGGEATRHRAPPHAPTHCSAGSAAIARRPSLXRTWSVSGAREQARARSSRXRCVVGR

SEQ ID NO: 38326 - DNA, 681 bp, Zea mays
  misc_feature: Ceres CLONE 1426316-F
  misc_feature: Encodes the peptide sequence at SEQ ID NO. 38327
aaagctggagctccccgcggtggcggccgctctagaactagtggatcccccgggctgcaggaattcgcacgagaccattacctagaacatcctaatcgaaaaaaaacgtccgtctcatcgatatccttatcgcttccgatctgataaacccccgccgccgtgacctcacatcgaccctgacctcgctctaggctttcattgcacgcctcgcgtctccagtggaagggatgcagaaaggaaaggatggcatctcctataccctcccgatcgggacaggctgcagcatcttgccgctgatacacagaccaggcgtgcactaactcctcgaaaatactcacggacgaggatgtaagaacattaacaattctggtgatagtcaaaggcggagtgggaaagtcgtacactgataaatccctccctggggacagacttacatctgtcgacgatttccgatcagatggtcggataccaatgatgtgctcacacacaacggcagggtgcattttaaaaaataccgactctcctgggcttattgaaggtggatacattactgagcacgtcgttgacatctggtggagatttcgtctatgacagactatctatgttcacctgtacctggatcgtttggatacatatataatggatacgctgcaagaacttgttataagatccatcgccaat

SEQ ID NO: 38327 - protein, 39 aa, Zea mays
  misc_feature: Ceres CLONE 1426316-F
MMCSHTTAGCILKNTDSPGLIEGGYITEHVVDIWWRFRL

SEQ ID NO: 38328 - DNA, 654 bp, Zea mays
  misc_feature: Ceres CLONE 1426319-F
  misc_feature: Encodes the peptide sequence at SEQ ID NO. 38329
  misc_feature (577)..(577): n is a, c, t, g, unknown, or other
aaactggagctccccgcggtggcggccgctctagaactagtggatcccccgggctgcaggaattcgcacgagaccattacctagaacatcctaatcgaaaaaggattttgtttcgggtgaggtggggggcggcatggagccacccgccgctcaggctcagctcctcctctccaaccacccctcgccgttgctgtcgccgccgcaacgtcgtcgcctcctcggtggaccgccgcctcgctcacacacctgcaccatccggcaccaccacggccacgacaagtgcgcctcctcctcctccactcgacttcgacacgccctccgcccgcccgccgccaccgccgtggacatcgcgcccggcgaccactggggaaactgggccttcctcctctccgacgccgcgttcggcacatgggcggaggagaacacgtcgtggggcgccgcgctcagcggcgcgctggttagcatcatggccggcctggctgccacggacgtcggcctcgtcacccccggtgcgcccgcgcacgacgccgtcatggagtacctgctgcaggccgccgtcccgctgctactcatcggnaccgacctccgccgcgtcgtcagcaccaccggcgacctcatcaaggcattcctgctcggatctgttgcaactgtaat

SEQ ID NO: 38329 - protein, 173 aa, Zea mays
  misc_feature: Ceres CLONE 1426319-F
MEPPAAQAQLLLSNHPSPLLSPPQRRRLLGGPPPRSHTCTIRHHHGHDKCASSSSTRLRHALRPPAATAVDIAPGDHWGNWAFLLSDAAFGTWAEENTSWGAALSGALVSIMAGLAATDVGLVTPGAPAHDAVMEYLLQAAVPLLLIGTDLRRVVSTTGDLIKAFLLGSVATV

SEQ ID NO: 38330 - DNA, 610 bp, Zea mays
  misc_feature: Ceres CLONE 1426321-F
  misc_feature: Encodes the peptide sequence at SEQ ID NO. 38331
  misc_feature (52)..(52): n is a, c, t, g, unknown, or other
  misc_feature (318)..(318): n is a, c, t, g, unknown, or other
  misc_feature (329)..(329): n is a, c, t, g, unknown, or other
  misc_feature (332)..(332): n is a, c, t, g, unknown, or other
  misc_feature (334)..(334): n is a, c, t, g, unknown, or other
  misc_feature (342)..(342): n is a, c, t, g, unknown, or other
  misc_feature (345)..(345): n is a, c, t, g, unknown, or other
  misc_feature (362)..(362): n is a, c, t, g, unknown, or other
aaagctggagctccccgcggtggcggccgctctagaactagtggatcccccngggctgcaggaattcgcacgagaccattacctagaacatcctaatcgaaaaacggccaatgcaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacgccgcctacaggagcgtgcaggggtatagggtggtcggnaaagaaaagcngcngntgggtccnttnggaaaagtgggtggaancgcaattcgtcctctccctctcttcccacggtgcggtcaagtttgcctgccccgcgccgcgccccgatactgccagcggggtgcccaccccgcccggggttccccaaggaacaaacctcaacccttggggttgcattgtggaatttaaatccggggccgcggttgttcgtttctccccgcggcggccgggggttttccccttttggggaaccccaggtgggggatactggtttaaaacggaaaaaaga

SEQ ID NO: 38331 - protein, 96 aa, Zea mays
  misc_feature: Ceres CLONE 1426321-F
  misc_feature (37)..(37): Xaa is any aa, unknown, or other
  misc_feature (38)..(38): Xaa is any aa, unknown, or other
  misc_feature (39)..(39): Xaa is any aa, unknown, or other
  misc_feature (42)..(42): Xaa is any aa, unknown, or other
  misc_feature (48)..(48): Xaa is any aa, unknown, or other
MDAAVSTLTALAIFASTVEHAAYRSVQGYRVVGKEKXXXGPXGKVGGXAIRPLPLFPRCGQVCLPRAAPRYCQRGAHPARGSPRNKPQPLGLHCGI

SEQ ID NO: 38332 - DNA, 681 bp, Zea mays
  misc_feature: Ceres CLONE 1426329-F
  misc_feature: Encodes the peptide sequence at SEQ ID NO. 38333
  misc_feature (443)..(443): n is a, c, t, g, unknown, or other
  misc_feature (551)..(551): n is a, c, t, g, unknown, or other
  misc_feature (552)..(552): n is a, c, t, g, unknown, or other
  misc_feature (615)..(615): n is a, c, t, g, unknown, or other
  misc_feature (624)..(624): n is a, c, t, g, unknown, or other
  misc_feature (625)..(625): n is a, c, t, g, unknown, or other
gctccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgccccttctccagtcgatcccatggatttaacacttncacaagacccccgaccgcgagtggttcgagaccgacgcggtgctcagggtcagcctcgggaacttcctcttctttcacatcctcgccgtcatcatggccgggataaanngacagatggaccccgtgacaagatccaccacggcggatgtatggcaaagattctctgctgggncaacatcgnncttcctcatgtttttcgtgccaaacgggggccgtcagcttcaatgattctatatca

SEQ ID NO: 38333 - protein, 63 aa, Zea mays
  misc_feature: Ceres CLONE 1426329-F
MWAASCLASCCAACACEACRTAVGSIGRRSARIAYCGLFALSLFASWALREVAAPLLQSIPWI

SEQ ID NO: 38334 - DNA, 622 bp, Zea mays
  misc_feature: Ceres CLONE 1426333-F
  misc_feature: Encodes the peptide sequence at SEQ ID NO. 38335
tggagctccccgcggtggcggccgctctagaactagtggatcccccgggctgcaggaattcgcacgagaccattacctagaacatcctaatcgaaaaatcatcatccaatccagatcagcaaagcggcagtgcgtatagaggatcgtcgaacagaacagcatgaagatggtcatcgttctcgtcgtgtgcctggctctgttagctgccagcgcctctgcaatgcatatgccctgcccctgcgcggggctgcagggcttgtacggcgctggcgccggcctgacaacaatgatgggcgccggcgggctgtacccctacgcgaagtacctgaggcagccgcagtgcatcccgctggcggcggcgccctactacaccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcaactgctggaagcccagggtctcaaccccatggccatgatgatggcgcacatcatgcgggccatgggtgga

SEQ ID NO: 38335 - protein, 154 aa, Zea mays
  misc_feature: Ceres CLONE 1426333-F
MKMVIVLVVCLALLAASASAMHMPCPCAGLQGLYGAGAGLTTMMGAGGLYPYAKYLRQPQCIPLAAAPYYTGCGQPSAMFQPLRQQCCQQQMRMMDVQSVAQQLQMMMQLERAAAASSSLYEPALMQQQQQLLEAQGLNPMAMMMAHIMRAMGG

SEQ ID NO: 38336 - DNA, 614 bp, Zea mays
  misc_feature: Ceres CLONE 1426342-F
  misc_feature: Encodes the peptide sequence at SEQ ID NO. 38337
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (220)..(220): n is a, c, t, g, unknown, or other
  misc_feature (221)..(221): n is a, c, t, g, unknown, or other
  misc_feature (261)..(261): n is a, c, t, g, unknown, or other
  misc_feature (267)..(267): n is a, c, t, g, unknown, or other
  misc_feature (270)..(270): n is a, c, t, g, unknown, or other
  misc_feature (304)..(304): n is a, c, t, g, unknown, or other
  misc_feature (339)..(339): n is a, c, t, g, unknown, or other
aagctggagctccaccgcggtnnngcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtnngacgcagcgcatctacggcggcgcccacgccacctacggncagcancancagcagggaggaagcgggcgccccaatggtgagncagtgaagggcatgcctcaacaaagggggccaaanggttcccaaggccttaaagtggtgaaacttttttcccccttgcgcggctcctttctgggcttttcgggcctggccttaacaccctccgtggtggggttgggcctggccccccccggggttcctaaattttaaccccgggttttccccccccccggtttttttagggaaaggggccaaggggggtccccccaccgggggcctctgggggtctgggggccttttccccccaaaaaggccccccaaaaaaggggggggagggggtttccacccccccc

SEQ ID NO: 38337 - protein, 87 aa, Zea mays
  misc_feature: Ceres CLONE 1426342-F
  misc_feature (5)..(5): Xaa is any aa, unknown, or other
  misc_feature (20)..(20): Xaa is any aa, unknown, or other
  misc_feature (21)..(21): Xaa is any aa, unknown, or other
  misc_feature (33)..(33): Xaa is any aa, unknown, or other
  misc_feature (44)..(44): Xaa is any aa, unknown, or other
MADRXTQRIYGGAHATYGQXXQQGGSGRPNGEXVKGMPQQRGPXGSQGLKVVKLFSPLRGSFLGFSGLALTPSVVGLGLAPPGVPKF

SEQ ID NO: 38338 - DNA, 649 bp, Zea mays
  misc_feature: Ceres CLONE 1426347-F
  misc_feature (229)..(229): n is a, c, t, g, unknown, or other
  misc_feature (309)..(309): n is a, c, t, g, unknown, or other
aaagctggagctccccgcggtggcggccgctctagaactagtggatcccccgggctgcaggaattcgcacgagaccattacctagaacatcctaatcgaaaaatcacacagcgccaccgcgtggttcgttaggaaaggaaatcgattcccccgcatccgatctcttcggtgctagagaaatataggccgcccgctcctcctcatttcgtgaaaggtggcggttaggttngggagatctcttgactcacgacacgagcagcaaaattcctcaagggccccctggttgcttccaaaaggtccgggctttcntgggatcttgaaaattggatgttccaatggaatccaagggtggcaagaaaaaatctaccacaaacccgtcccccccggagggagaaaaccccccttggttacaaaatccaagaatttccccccttggaggggggataaaaaaatttttcccctggttttttcaaaaaggggggggaaaaccccccgggaattttttgtggcccccccccccccaaaagagggaaaaaacccccgccgttttttttttttttttctccccaaacccccccgggggaattgtgttttttcggggggaaaaaaaaatttaaaaaaaaattttccggttttctcccccgggggg

SEQ ID NO: 38339 - DNA, 672 bp, Zea mays
  misc_feature: Ceres CLONE 1426355-F
  misc_feature: Encodes the peptide sequence at SEQ ID NO. 38340
aaagctggagctccccgcggtggcggccgctctagaactagtggatcccccgggctgcaggaattcgcacgagaccattacctagaacatcctaatcgaaaaaccctcccccatttttcccttggttggccgtcccctctcctcccatggcagccgcccaccatttcttcctcctccatagatctccccctcccccatgcagcaaggatcgagaagaggaggagcaagatggattgaagaggaagagaggatcaaggagatgttctacccccccatctattgcagattttcttggggaaactctaggtacttgattcatgttgggaatgaggggagtagcagcacgtccaccttcactctcataataacgctgcccaggcacaaccatgatttaattagaaacttcttgtcaaaggatgtttgtctttaactagtcatgcacactagttaattcaattcatgtcgttatggttatcttctcattgctagccgattattaatgtctattatgttttcttatcatgatatctgcttatactctgttgcttccacgtttatgcaaattttcaaaggagatgctgtcaaaattttatatatgaatgttagttgtgtagtttagtagcatttcaggatgtttgtggatcctggggtgttacagaagacgagagctat

SEQ ID NO: 38340 - protein, 55 aa, Zea mays; identical to SEQ ID NO: 16588
  misc_feature: Ceres CLONE 1426355-F

SEQ ID NO: 38341 - DNA, 631 bp, Zea mays
  misc_feature: Ceres CLONE 1426366-F
  misc_feature: Encodes the peptide sequence at SEQ ID NO. 38342
agagctggagctccccgcggtggcggccgctctagaactagtggatcccccgggctgcaggaattcgcacgagaccattacctagaacatcctaatcgaaaagagaactccatttcgatctcatttgaaatcaacccatcctcgtttcctccgtctagcagcctctcaccctcatggccaagatcaagatcgggatcaatgggtttggcaggatcagaaggctggtggccagggtggccctgcagaccgacaacctcaagctcgtcgccgtgaacgaccccttcatcagcaccgattacatgacctacatgttcaagtatgacactgtgcacggacagtggaagcaccatgaggtcaaggtgaaagactccaacacccttctctttggtgagaaggaggttgctgtgtttggctgcacgaaccctgaggagatcccatggggttcggttggcgctgaatatgttgttgagtctactggtgttttcactgaccagtagaaggctgcagctcacttgaagggtggtgccaagaaggttgtcatttctgctcctagcaaggatgcccccatgttcgttgttggtgtcaacgagaaggagtacaagtctgacatcaacattgactctgatgctag

SEQ ID NO: 38342 - protein, 107 aa, Zea mays
  misc_feature: Ceres CLONE 1426366-F
  misc_feature (4)..(107): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIRRLVARVALQTDNLKLVAVNDPFISTDYMTYMFKYDTVHGQWKHHEVKVKDSNTLLFGEKEVAVFGCTNPEEIPWGSVGAEYVVESTGVFTDQ

SEQ ID NO: 38343 - DNA, 642 bp, Zea mays
  misc_feature: Ceres CLONE 1426367-F
  misc_feature: Encodes the peptide sequence at SEQ ID NO. 38344
aagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagctttgatgcgtgtccgtccctgatgctgcagcaactgttggccttacggcttcgacgatgccagtgatgatgccacagatgatgacgccttacatgatgtcaccattgatgatgccaagcatgatgtccccaatgggccttgccaacatgatttcccaaatgatgatgcccaattgttcttgagaacccctttccccaaattatgctgcaaacccggtacacttttcggtttaaccccatgggcttgaaaatttcccccctgttttttaaccaaccctttgggggggcgccctcccaaaaaaaaaaatttttggtggatccaaaaa

SEQ ID NO: 38344 - protein, 73 aa, Zea mays
  misc_feature: Ceres CLONE 1426367-F
MAAKMLALFALLALCASATSATHIPGHLPPVMPLGTMNPCMQYCMMQQGLASFDACPSLMLQQLLALRLRRCQ

SEQ ID NO: 38345 - DNA, 706 bp, Zea mays
  misc_feature: Ceres CLONE 1426368-F
  misc_feature: Encodes the peptide sequence at SEQ ID NO. 38346
  misc_feature (87)..(87): n is a, c, t, g, unknown, or other
aagctggagctccccgcggtggcggccgctctagaactagtggatcccccgggctgcaggaattcgcacgagaccattacctagaancatcctaatcgaaaaatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccctgccagatgcaatgatgatgcccagtatgatgccaccgatgaacatgatgccgatgccgaatatgatgcatcgatgatggtggcgactatgatgtccccaatacgatagctagattatgcaccgattatgatcccaaaaatgggttcccccaataataagccaaaattatgccttccaaataacccaaaattgagcccccaaaatggtgccaaaataaaaccccccaaaaaagcccaacctggggtctcaataaaatggccaaatgagaaacggggcccaatttttcttaattcccctcccaataaataaaaaaaaattttactttttttttccccccaccgcggggc

SEQ ID NO: 38346 - protein, 76 aa, Zea mays
  misc_feature: Ceres CLONE 1426368-F
MAAKMFALFALLALCATATSATHIPGHLSPLLMPLATMNPWMQYCMKQQGVANLLAWPTLMLQQLLASPLQPCQMQ

SEQ ID NO: 38347 - DNA, 647 bp, Zea mays
  misc_feature: Ceres CLONE 1426371-F
  misc_feature: Encodes the peptide sequence at SEQ ID NO. 38348
  misc_feature (566)..(566): n is a, c, t, g, unknown, or other
aagctggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggtgatggaactancactgcctctgttctcgctagggagatcatcaaattgggcatgttgagcattacttcaggggcaaatccagtgtccgttag

SEQ ID NO: 38348 - protein, 161 aa, Zea mays
  misc_feature: Ceres CLONE 1426371-F
  misc_feature (135)..(135): Xaa is any aa, unknown, or other
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTXTASVLAREIIKLGMLSITSGANPVSV

SEQ ID NO: 38349 - DNA, 648 bp, Zea mays
  misc_feature: Ceres CLONE 1426373-F
  misc_feature: Encodes the peptide sequence at SEQ ID NO. 38350
aagctggagctccccgcggtggcggccgctctagaactagtggatcccccgggctgcaggaattcgcacgagaccattacctagaacatcctaatcgaaaaatatctatccagccatctcctcaccctcgttcacgacaaaggacgaccctcctttagtagcttgtgatttgagcgtcaactagatcactgttccggtggcggacaacgactcatggagaagggtagtgtggtcgcatcatggtgggcgttcctcctgctcgccggcgtgctgctggtcgcaccacccacatctggtgcacaggacggattgatcgaacggcaccgtaaggaggacctgcgcaggaacaagcacgcgtgcgagtggcattacagaaaggacatcccgagcaagatgcaatgccatagccagtgccgcgagcgggatcagcactgctgacgcgggctaagactgcgacagtggattgcactcctacttctcacgcatcggaaggtgcgagtgccggctccaatgcctaggccgccttcagagccagccctgagagacccaagaatgcatgaggcggtgcctccaccgcgaactgccctgcgattggtaacaagagtaccgtcgcggtaaatagatcgcagtgtcgtgccgtgagaggcg

SEQ ID NO: 38350 - protein, 74 aa, Zea mays
  misc_feature: Ceres CLONE 1426373-F
MEKGSVVASWWAFLLLAGVLLVAPPTSGAQDGLIERHRKEDLRRNKHACEWHYRKDIPSKMQCHSQCRERDQHC

SEQ ID NO: 38351 - DNA, 663 bp, Zea mays
  misc_feature: Ceres CLONE 1426374-F
ctccccgcggtggcggccgctctagaactagtggatcccccgggctgcaggaattcgcacgagaccattacctagaacatcctaatcgaaaaccgcagttcccacccaccaaaccaaactctcctccacaaccacaacctcccccgccgcccctcctcttctcggcttctcccctgccttgttcggccccaaaacggcaagagccgacgccagcaaaccctcgggttcgggagggaaggaaggcacgagcagtgcggctgcctacccgcagctaaccccaaacagcaacgtcgtagccgacgagagcctccgccacctacccaccaactcccgcccgtcgtcgcctccgcttgggttctcgtcgagcagttggtgggcacctaccgcatccagccacagagagagagtgagccactgagccagggcggcaagggggagatgaagaagctgtaccagggcggcaagggggcggcgggtgcacccggcgccggctgacgcatcggcagccgtggcgctgccggccgccgtgctggccctggcgtccgcgctgacggccgaggagcaggaggtgctggcctacctcctgtcctgcggcggcggccggcaccaccacggccacggccgccgccgcggggcccacccgccggagatgggctgcgcctg

SEQ ID NO: 38352 - DNA, 673 bp, Zea mays
  misc_feature: Ceres CLONE 1426376-F
  misc_feature: Translation starting site: 254
aaagctggagctccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctggctggagagcagtttacatgaaaagataattgaggcatgcaacaaccttattgcaaagctcaagtaagtgaggtagtcacgaatggctcagttgatgaattccctgaatcacatttcccatatggctcggaacaacggttgggtggaaatgccccactggagtatgcaagctttacaataagatttggctcattgaatgtgacccaatg

SEQ ID NO: 38353 - DNA, 666 bp, Zea mays
  misc_feature: Ceres CLONE 1426378-F
  misc_feature: Translation starting site: 472
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcaggtaacctgcggcgttggcagcaccccgatcctggggcagtgcgtcgagttcctgaggcatcagtgcagcccgacggcgacccctactgctccgctcantgcagtcgttgcggcagcaatggtgccagcccctcaagcaggtggagccccacc

SEQ ID NO: 38354 - DNA, 580 bp, Zea mays
  misc_feature: Ceres CLONE 1426379-F
  misc_feature: Encodes the peptide sequence at SEQ ID NO. 38355
  misc_feature (1)..(1): n is a, c, t, g, unknown, or other
  misc_feature (338)..(338): n is a, c, t, g, unknown, or other
  misc_feature (383)..(383): n is a, c, t, g, unknown, or other
  misc_feature (419)..(419): n is a, c, t, g, unknown, or other
  misc_feature (450)..(450): n is a, c, t, g, unknown, or other
naaagctggagctcaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacngcgtcgcaggcgctgacggtggcgacgctgttcccgctgggcggnctgctgctggtgctgtcggggctggcgctgacgccntcccgtggtggggctgggccgtggccacccnggtgttcctgatcttcagccccgtgctggtcccccgccggctgctcaatgggaacggcggtatggggttcctccagttcggggcccctggggcctgggggcctttccctccctccagtggctcgcaaaaa

SEQ ID NO: 38355 - protein, 84 aa, Zea mays
  misc_feature: Ceres CLONE 1426379-F
  misc_feature (82)..(82): Xaa is any aa, unknown, or other
MADRDRSGIYGGAHATYGQQQQQGGGGRPMGEQVKGMLHDKGPTASQALTVATLFPLGGLLLVLSGLALTPSRGGAGPWPPXCS

SEQ ID NO: 38356 - DNA, 639 bp, Zea mays
  misc_feature: Ceres CLONE 1426381-F
  misc_feature: Encodes the peptide sequence at SEQ ID NO. 38357
  misc_feature (639)..(639): n is a, c, t, g, unknown, or other
aagctggagctccccgcggtggcggccgctctagaactagtggatcccccgggctgcaggaattcgcacgagaccattacctagaacatcctaatcgaaaaacctagaacatcttaatcgaaaattatattcttctgcctgcccttccgttcaatttcaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaatatgctggtttttgtgacgccccatcaatttgtggagggtatatgtaagaagcttgtaggaaagctaacaccaggn

SEQ ID NO: 38357 - protein, 119 aa, Zea mays
  misc_feature: Ceres CLONE 1426381-F
  misc_feature (10)..(119): Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
MEMENGHAKYRVAVIGSGNWGSVASRLIASNTAKLPSFYDEVRMWVFEEILPTGRKLSESINEQNENCKYLPGIKLGTNVIADPDLESAVKDANMLVFVTPHQFVEGICKKLVGKLTPG

SEQ ID NO: 38358 - DNA, 661 bp, Zea mays
  misc_feature: Ceres CLONE 1426394-F
  misc_feature (578)..(578): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaaatccattggtgtggacgtgtcacgtgtggtggttgcgttgcggggccccgatttcgagcgggtgttcaattttggtgccggatttttaaggaggatccaatttaggaagaattttggttttggggacaatggttttggactgcctgatattcgattcataggttggtcaaacgctttggagtagagaatttttttcccggaaaagaagagccatttttctagttgtgctactcgtcaatcaatccagtgaagctgaactctggaagaagaaactttcctaattagacccggtatttcgtggttggccgttggcgtctaaagtctaatttatttgtcgcgttttagtttaaaaatgaacatatttttctgtttactccgcccaaaatctttccgctggatctacttgtgaatcgggtttgtttgttttttatctgagctattcttgttgatttaggatttcgattcggcagatccangggaacgccgaattttgcctgatttcnttcgcatttttggtcccgatcagaggctccaagccttttttttttcactcgcgaga

SEQ ID NO: 38359 - DNA, 700 bp, Zea mays
  misc_feature: Ceres CLONE 1426396-F
  misc_feature: Encodes the peptide sequence at SEQ ID NO. 38360
  misc_feature (515)..(515): n is a, c, t, g, unknown, or other
  misc_feature (548)..(548): n is a, c, t, g, unknown, or other
  misc_feature (615)..(615): n is a, c, t, g, unknown, or other
aagctggagctccccgcggtggcggccgctctagaactagtggatcccccgggctgcaggaattcgcacgagaccattacctagaacatcctaatcgaaaaaaaaccctagcgcccccggccccggtctccgcccccccgccttcgccgtcgcggtcgcgccccatggcggggaagtcgcgaccgcccaagcggatcctcgagtcctataccatcaagggttcggacagagtcatcaagcctggcgattgcgtgctaatgagggcatctgatgcttcaaagccaccttatgtggcaagagttgaggcaattgaagcagcaggatctcgaggcaccaatgtgagagtacgagtgcggtggtattatcgaccagaggagtccataggtggtcggcggccatttcatggttccaaggaggttttcctctctgaccactatgatgtacaaagtgctgacaccattgaggggaaatgcaatgtccacagcttccgtagctatacaaagcttgattctgtncatgctgaggatttcttctgccgcttcgagtantaatcagctactggcagctttgtaccagatcgtatagcagtgtttttgcagtgcgagatgccatacnatccagatgaccttatgatccatgcgaggaaatgtctgactgggttcaccctgcttgcattgggatgacaatcaagaagcaagaa

SEQ ID NO: 38360 - protein, 127 aa, Zea mays
  misc_feature: Ceres CLONE 1426396-F
  misc_feature (22)..(129): Pfam Name: BAH Pfam Description: BAH domain
MAGKSRPPKRILESYTIKGSDRVIKPGDCVLMRASDASKPPYVARVEAIEAAGSRGTNVRVRVRWYYRPEESIGGRRPFHGSKEVFLSDHYDVQSADTIEGKCNVHSFRSYTKLDSVHAEDFFCRFE

SEQ ID NO: 38361 - DNA, 613 bp, Zea mays
  misc_feature: Ceres CLONE 1426402-F
  misc_feature: Encodes the peptide sequence at SEQ ID NO. 38362
  misc_feature (261)..(261): n is a, c, t, g, unknown, or other
  misc_feature (288)..(288): n is a, c, t, g, unknown, or other
  misc_feature (319)..(319): n is a, c, t, g, unknown, or other
  misc_feature (336)..(336): n is a, c, t, g, unknown, or other
  misc_feature (374)..(374): n is a, c, t, g, unknown, or other
aagctggagctccccgcggtggcggccgctctagaactagtggatcccccgggctgcaggaattcgcacgagaccattacctagaacatcctaatcgaaaatacatacatgctagcgaggttattttatccatcctgctggacaaggacaggagcagctcgacaatcctctcgctgaaaaaggctggtcctgagatcactgaacttttaacgcaatgctctatcggcattgctggaactggactggctattctcctgtcangtatgtgcaagatgtctaatggcatgnagactccttttgcttctgcccgactgcttancaccagcgtcggaatcngactcctcttgctatccctgggcagtccatggattgcntgaacaccatcgccagcattttccaaaacccaaatggcctgatattccaagaatgaccaggtccccattgaaattaaaaaaaaatgtggacggaaatcctcctcccaggggatttaatctccctggggaatcctggcccttaaattttgcctaacccgccctccccatttttttaaggtttttccaagcccttttgaaatacccccccctttctcattttggttcacgaaagtagaaca

SEQ ID NO: 38362 - protein, 124 aa, Zea mays
  misc_feature: Ceres CLONE 1426402-F
  misc_feature (87)..(87): Xaa is any aa, unknown, or other
  misc_feature (96)..(96): Xaa is any aa, unknown, or other
  misc_feature (106)..(106): Xaa is any aa, unknown, or other
  misc_feature (112)..(112): Xaa is any aa, unknown, or other
AGAPRGGGRSRTSGSPGLQEFARDHYLEHPNRKYIHASEVILSILLDKDRSSSTILSLKKAGPEITELLTQCSIGIAGTGLAILLSXMCKMSNGMXTPFASARLLXTSVGIXLLLLSLGSPWIA

SEQ ID NO: 38363 - DNA, 718 bp, Zea mays
  misc_feature: Ceres CLONE 1426403-F
  misc_feature: Encodes the peptide sequence at SEQ ID NO. 38364
  misc_feature (695)..(695): n is a, c, t, g, unknown, or other
  misc_feature (702)..(702): n is a, c, t, g, unknown, or other
  misc_feature (718)..(718): n is a, c, t, g, unknown, or other
aagctggagctccccgcggtggcggccgctctagaactagtggatcccccgggctgcaggaattcgcacgagaccattacctagaacatcctaatcaaaaaaaaatctcaaaaacccaacctttactattttgtttcttccttactccaaccaaacacttctcgtctccaatggcttccttatccttcgtctcatcatctcacctcactctacgcgctccttctcccaacaacctccgctcctcatctccccgtcccacctccgtttcattctccgtcaaggcccagtccgtcgcactctcccaagacgacctaaagaaactcgccgccgaaaaagccgtcgaatccatcaaaccaggaatggtcctcggcctcggaaccggctccaccgccgccttcgccgtcgaccaaatcggaaaactcctctcctccggccaactccacgacatcgtcggcatcccgacgtcaaaacgaaccgaagaccaggccagatccctcgggatccccctcgtggccctcgacacgcaccccagaatcgacctggccatcgacggcgccgacgaggtggatcccaacctggacctggtcaaggggcgcggcggcgcgctcctgagggagaagatggtggaggccgtggccgagagatttatcgtcgttgcggatgatacaaagctcgtgaaggggctgggagggagncgtttancgatgccagtggaggn

SEQ ID NO: 38364 - protein, 182 aa, Zea mays
  misc_feature: Ceres CLONE 1426403-F
  misc_feature (93)..(182): Pfam Name: Rib_5-P_isom_A Pfam Description: Ribose 5-phosphate isomerase A (phosphoriboisomerase A)
  misc_feature: SWISSPROT Homolog: EC 5.3.1.6 Ribose-5-phosphate isomerase
  misc_feature (175)..(175): Xaa is any aa, unknown, or other
  misc_feature (178)..(178): Xaa is any aa, unknown, or other
MASLSFVSSSHLTLRAPSPNNLRSSSPRPTSVSFSVKAQSVALSQDDLKKLAAEKAVESIKPGMVLGLGTGSTAAFAVDQIGKLLSSGQLHDIVGIPTSKRTEDQARSLGIPLVALDTHPRIDLAIDGADEVDPNLDLVKGRGGALLREKMVEAVAERFIVVADDTKLVKGLGGXRLXMPVE

SEQ ID NO: 38365 - DNA, 655 bp, Zea mays
  misc_feature: Ceres CLONE 1426405-F
  misc_feature: Encodes the peptide sequence at SEQ ID NO. 38366
  misc_feature (587)..(587): n is a, c, t, g, unknown, or other
  misc_feature (599)..(599): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacaccccgctcaacttcgacgccttccacggcgacnaggaccacggcnggcntgcacgacggcaccgccgtcgtgctctgggaagtgtggcaggggcaaaaacc

SEQ ID NO: 38366 - protein, 164 aa, Zea mays
  misc_feature: Ceres CLONE 1426405-F
  misc_feature (142)..(142): Xaa is any aa, unknown, or other
  misc_feature (146)..(146): Xaa is any aa, unknown, or other
  misc_feature (147)..(147): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTPLNFDAFHGDXDHGXXARRHRRRALGSVAGAKT

SEQ ID NO: 38367 - DNA, 610 bp, Zea mays
  misc_feature: Ceres CLONE 1426412-F
  misc_feature (371)..(371): n is a, c, t, g, unknown, or other
tggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccgggtcacctgccgccgccggtccacctgcaccgncggtcatgtgcccgcgccggttcatctgccgccgccacatgcactaccctactcaaccggcccggcctcagcctcatccccagccaaaccatgcccgtggccaacagcccatccagcccggtgcactgcagggaacctggggggttggcacccccccgatcctgggcattggcgtcaagttcccgaggatttaggggaaccccaagggggaacccctaatgggtccccccaggggcagg

SEQ ID NO: 38368 - DNA, 715 bp, Zea mays
  misc_feature: Ceres CLONE 1426416-F
  misc_feature: Encodes the peptide sequence at SEQ ID NO. 38369
ggagctccccgcggtggcggccgctctagaactagtggatcccccgggctgcaggaattcgcacgagaccattacctagaacatcctaatcgaaaaacttttcagatcgacaaaggggaaaggttcgcttcttgtggcatcttgctttatttcgagtgccatggccgatccggcggaggataacgttgtcttcctgcctccgacccctgcggacccagccgtgggcgcctcacacccgcccctgcagcctgctgttgacagcgcctcaacggagaaggtgtctgctcctgctccagaggtaaggtcccggggattcaggcttcttgtagaggacacttccgtgcacaaatcccttgggggcggtaaaactgctgatgttctgttatggaaagacaagaaaacttctgctgttgtaataggcggcccaactgtcatctggattctgttcgaagtggttgattacgacgtcctgaccctgatatgccatgcactgattggtgtgcttgccgccttattcctgtgttccagagccaccaccttcatcaccaagagtcctccggatacttcgctagtgcaggtatctgaggaccttgctgagaatgtttcacggccattacggaatgacatcgactgagcgcttcacttgttcccgggagatcacgatgtggcatgatctgaagaagtttttgggtgcgatcctgaggctgacggttcc

SEQ ID NO: 38369 - protein, 157 aa, Zea mays
  misc_feature: Ceres CLONE 1426416-F
  misc_feature (70)..(157): Pfam Name: Reticulon Pfam Description: Reticulon
MADPAEDNVVFLPPTPADPAVGASHPPLQPAVDSASTEKVSAPAPEVRSRGFRLLVEDTSVHKSLGGGKTADVLLWKDKKTSAVVIGGPTVIWILFEVVDYDVLTLICHALIGVLAALFLCSRATTFITKSPPDTSLVQVSEDLAENVSRPLRNDID

SEQ ID NO: 38370 - DNA, 664 bp, Zea mays
  misc_feature: Ceres CLONE 1426418-F
  misc_feature: Encodes the peptide sequence at SEQ ID NO. 38371
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcgaaaaatcatcatgtttgactgcagtctgcacggggtgtggccgcgctgaagcctgcctgtcaatctctatcaatctaggagtggcttgcccatatggcgaaccggccgttctcttcctgctctcattattgctatccccgttcttgctggcatttactgcctcatggcgagctcggcctcgccggccgtggaagatgatctgtgctgtggaggaggagccagatgacccacaaccatgccacaacacgcagaatctcgaatgatgtccatcaccatcttcaagtccgctgttatctacggatctgtgtgcatggatagaacgctccctgttctacacttgtatcctggctccagagcccccagctgacactggattgtgcacttacatggaggtacctggtgctacagcgtcaagacatgccggctctacangactacaggtcgctggatcgtcagaccacatcgcacaaggagatcgcccttctctggcatcattgagcagcagcacgtaccactgaatgcatagactacgcaccgattcgtatattcatacctctgagaacggg

SEQ ID NO: 38371 - protein, 43 aa, Zea mays
  misc_feature: Ceres CLONE 1426418-F
MPQHAESRMMSITIFKSAVIYGSVCMDRTLPVLHLYPGSRAPS

SEQ ID NO: 38372 - DNA, 651 bp, Zea mays
  misc_feature: Ceres CLONE 1426425-F
  misc_feature: Encodes the peptide sequence at SEQ ID NO. 38373
aagctggagctccccgcggtggcggccgctctagaactagtggatcccccgggctgcaggaattcgcacgagaccattacctagaacatcctaatcgaaaaccaaagacacgattgtagttggattaattcataccccacaaccccccatcagaagaacttgttgcgatcgagtatgtcatcaactacccgccgcgggaacccatggaaggaggcaaagcaaaggcttctacgcatggtttcccgacggcggcttctgcgacgggcgccatgaacagcagccagcatgcgctgatttaaggcttcctggccagaggctccgtcgtgctggttgagcacacagccttctccggaaagttcagcaccgttgccagtacagtgcctccagaaacttccccccaacagcagccagatccacctactacggggacggccaaaccttcaaattactacgtaaccgcggcttcgagtacctagtggtcgccgatgaggcggacggcaggagcgtccccttcttcttcgtagacaaggctacggaagacttcatgcacctccatggggacagtatcaatgacgaggggcagcacccgctctctgatgatgctgatgacgatgactttctgttcgaagaccgggtcatcattgactacaa

SEQ ID NO: 38373 - protein, 35 aa, Zea mays
  misc_feature: Ceres CLONE 1426425-F
MHLHGDSINDEGQHPLSDDADDDDFLFEDRVIIDY

SEQ ID NO: 38374 - DNA, 646 bp, Zea mays
  misc_feature: Ceres CLONE 1426427-F
  misc_feature: Translation starting site: 148
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaagtacactagcttcggagtttctttcgaataattaaaacgaaaacaatggcgacggttcagttcttcaaccaattcccctgcacaacccgagtcgaaagcccaccaaaccctaaacccctctccaagccaacgactctggtgcctatgagcacgctcactcgccgtccgttgttctcccccggcgaattcgccgttacccgtgcggatttcacagtcatagtcatcaatgcagaagactagttggatccggagacgagtgagggaggatctgctctattgatggcagaggaagcatcgaatccgtggaagagacggaggttctcaagagatcgctggtggattcgatgaacagcacagaccgagggttgagcgcatcgagcgagacgagagccgagatcggagatctaatcacacagctcgagtccaagaccctacaccagctcccaccgatgatctcttccttctcgaacggaaatgtatcctcgagtacacatcgatcgttggttagctcccgttgctttcacgagcgatcgtgacgatagtn

SEQ ID NO: 38375 - DNA, 638 bp, Zea mays
  misc_feature: Ceres CLONE 1426428-F
  misc_feature: Encodes the peptide sequence at SEQ ID NO. 38376
aagctggagctccccgcggtggcggccgctctagaactagtggatcccccgggctgcaggaattcgcacgagaccattacctagaacatcctaatcgaaaactccactcctcctcctctctcactccgcatttgctctcccgataagagtgaggcctcggctaagcttgagcttcccctccctcccctccagtggtccagctcccctccatcctcggacaaaaattctgcggcgagctccgatccggtccgactactaacccacaccgcagaatccgcgcgacctgatagcgcgggggtcgaggaaaggggaagcgcggcgccccggttgcctgccaccgtaccaccgcatgagaaggaataggagcccgtatccctccgccccgctgcccgccggaccgatggactcagagcactggatctcgcgcctggccgccacgaaacgcttctacgcggcgcagctcggccacagcgatcgggccgggatggacgagctggagatggactaggaggtcaggcccaagttcccctgcccctactgctacgaggaccacgacgtcggatccctctgcgcgcacctgaaggaggagcacccggtcgaaccccaagccgcggcctgccctgtctgctcagagatgg

SEQ ID NO: 38376 - protein, 35 aa, Zea mays
  misc_feature: Ceres CLONE 1426428-F
MDSEHWISRLAATKRFYAAQLGHSDRAGMDELEMD

SEQ ID NO: 38377 - DNA, 648 bp, Zea mays
  misc_feature: Ceres CLONE 1426429-F
  misc_feature: SWISSPROT Homolog: EC 1.2.1.12 Glyceraldehyde-3-phosphate dehydrogenase (phosphorylating)
aagctggagctccccgcggtggcggccgctctagaactagtggatcccccgggctgcaggaattcgcacgagaccattacctagaacatcctaatcgaaaaatcacattcgcgaaccctgtcatcgatctcgtttcaaatccatccatccgaggttcctccgtcccgtaacatctcaaccccatggccaagatgaagatcgggatctatgggttcggcaggatcttgaaggctggaggtcagagtggccctgactagtgaccatgtcgagctcgtcgccgctgaactaccccttcgtcagcaccgaatacagtgaactacatgttcaagtactacactgtgcacggacagtggaagaaacatgagagcaaggtgaatcgactccaaaacccttctctttggagagaaggaggttgatgtgtttagctgcaggaaccctgaggagatcccgtggggttcggttggtgctgaatatgttgttgagtctacaggtgtttatcctgacacggacgaggatgcaggtcacttgaacggctgtgcctacaacgttgacatctctgctcctagaacagatggctccatgtttgacgatggtgtcaactacaaagactacgagtctgacatgtactgtgtgctccaatgatagctg

SEQ ID NO: 38378 - DNA, 605 bp, Zea mays
  misc_feature: Ceres CLONE 1426434-F
  misc_feature: Encodes the peptide sequence at SEQ ID NO. 38379
  misc_feature (331)..(331): n is a, c, t, g, unknown, or other
  misc_feature (340)..(340): n is a, c, t, g, unknown, or other
  misc_feature (372)..(372): n is a, c, t, g, unknown, or other
  misc_feature (376)..(376): n is a, c, t, g, unknown, or other
  misc_feature (439)..(439): n is a, c, t, g, unknown, or other
  misc_feature (442)..(442): n is a, c, t, g, unknown, or other
  misc_feature (454)..(454): n is a, c, t, g, unknown, or other
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgaacaagggccgacngcgtcgcangcgctgacggtggtgacgctgttcccgctggncggnctgctgctggtgctgtcggggctggcgctgaacgcctccgtggtggggctggccgtggccacnccngtgttcctgatncttcagcccgtgctcgtccccgccgcgctgctcatcgggacggccgtcatgggtttcctcacgtccggcccgctggggctcggggggctgtccctccctcacgtgctccgcaaccggggcggaagggttccagcgaaccccggactcctga

SEQ ID NO: 38379 - protein, 135 aa, Zea mays
  misc_feature: Ceres CLONE 1426434-F
  misc_feature (44)..(128): Pfam Name: Oleosin Pfam Description: Oleosin
  misc_feature (47)..(47): Xaa is any aa, unknown, or other
  misc_feature (58)..(58): Xaa is any aa, unknown, or other
  misc_feature (85)..(85): Xaa is any aa, unknown, or other
MADRDRSGIYGGAHATYGQQQQQGGGGRPMGEQVKGMLHEQGPTASXALTVVTLFPLXGLLLVLSGLALNASVVGLAVATPVFLXLQPVLVPAALLIGTAVMGFLTSGPLGLGGLSLPHVLRNRGGRVPANPGLL

SEQ ID NO: 38380 - DNA, 524 bp, Zea mays
  misc_feature: Ceres CLONE 1426438-F
  misc_feature: Encodes the peptide sequence at SEQ ID NO. 38381
  misc_feature (331)..(331): n is a, c, t, g, unknown, or other
  misc_feature (345)..(345): n is a, c, t, g, unknown, or other
aagctggagctccaccgcggtggggcggccgctctagaactagtggatcccccgggctgcaggaattcgcacgagaccattacctagaacatcctaatcgaaaaattttcctctcctcccccacagcagctcggcgaaaaccctagtaagcaaaccaccggagcagcggcgcttgcgcgagcggagccatggcggacgacgattacaacgaaattgacatggggtatgaggatgagcccccagaaccggagattgaggaaggagctgaagaagagcctgagaacaatgaagatgcccctgatgacgtcatacgtggtgaggggtgaagatnagggaacaggaaangaccaagcgtggacggcaaaccaaccaaatacctgtgacaaagtacgaaacgttgcgcgccatcctggggtacccaagcccttggcaaaaaaaccttgaatggccccccttttttgggttgaaactttgggggggaaaaacctgccccccccttggagaatttcaaaggaaaaggaact

SEQ ID NO: 38381 - protein, 45 aa, Zea mays
  misc_feature: Ceres CLONE 1426438-F
MADDDYNEIDMGYEDEPPEPEIEEGAEEEPENNEDAPDDVIRGEG

SEQ ID NO: 38382 - DNA, 622 bp, Zea mays
  misc_feature: Ceres CLONE 1426440-F
tggagctccccgcggtggcggccgctctagaactagtggatcccccgggctgcaggaattcgcacgagaccattacctagaacatcctaatcgaaaaatataaacacggcggggaggaaccagacatccctcgctcccaatatctctccccacctcccctgagcttctcccgacctttggtcaggcaaaggaggcggccaaaaaggacgagcgatggtgacacaaggtcatctgcttcctggcgctcgcatccgtgctcctcgccgtcgcttttcccgtgtcatgcatctgcggcagcatgagaacaagggcggcggcggtcaacgccgaggccgacgcttcgttagcggaaccggaggcggcaacctgaatccctgggagtgctcgcccaagtgcagatcgcggtgctccatcacacagtacaggaaggcctgcactcaccttatgcaacgagtgctgcgccaagggcctcggcttgccaccgggattctacgacaactagggcgcctgcccctgctacaacaactggaagaccagtgaaggagggcccaagtgcccctagaagatacaccggagctcccgtccgccagtgtccccccttctccgaatctggaacgtgttg

SEQ ID NO: 38383 - DNA, 656 bp, Zea mays
  misc_feature: Ceres CLONE 1426457-F
  misc_feature: Translation starting site: 237
  misc_feature (370)..(370): n is a, c, t, g, unknown, or other
  misc_feature (371)..(371): n is a, c, t, g, unknown, or other
aaagctggagctccccgcggtggcggccgctctagaactagtggatcccccgggctgcaggaattcgcacgagaccattacctagaacatcctaatcgaaaagacgacactgcacacctctcaccagtccccacacggccacaccacacccagctgtccccatcgcgcgcacactctctcggtctctccctcccagtcccagcgtttgcggtccagtccagagagctcgagcagccatggcggctcccctgttcctcctcctcctgctgctggctatgttcacaggctcagacgcggcgttctgcgtgtgcaagacgggcgtgcccgaccaggcgatgcaggcggcgatcgactacgcctgcgccaaggnnggcgactgcgcctcccgctccagggcgcgccctgctacggcaacggcaacaggtggccgtctgctcctacatctgcaacagctactaccagagccgcagcgccacgggcgccacctgcgactttcaacgggtcgccacgctcaccgggaccgaacccagctccggcacctgaaagtttcgcctccggccccaacaaccaaagcaacgggggggggcatgggccctgggcccggtaacccgcgggggcatggggccctggccccggcccccggaaaagggtttggc

SEQ ID NO: 38384 - DNA, 639 bp, Zea mays
  misc_feature: Ceres CLONE 1426460-F
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (212)..(212): n is a, c, t, g, unknown, or other
aagctggagctccccgcggtggcggccgctctagaacagtggatcccccgggctgcaggaattcgcacgagaccattacctagaacatcctaatcgaaaaatcgcttcagctcggcgtcttcacaaacgccggcgcaaactctcgcccgagcccgacagatctctaattccccatacnnngtcacgggtcgacttcacgcagtctccgtctncttccgaagcgtcccgcgcggttgtttaaaaggaagggagaaaattaggggttgcattccggccccatccggggaggccgggttcccaatggggaaaacggggtgggaaatttatgggccccaaacagggttcccccccgaaggggcaaagtccctgggaaaaaaaacccgggggacaccccaaaaatgccttttacaacttttttttacaaaaaagggggggggggggagaaaattccccccgggaattttttttgtttataaaacccccccttttttataaaaaaaggggggcggggggggaaaaaaaccccttttttttccccccgggggggggtttttttgggggggggggagagggggcgcgccaattttttcccccgcgccgcccccccccatctggggggggagagggaggtgtgtgtgt

SEQ ID NO: 38385 - DNA, 702 bp, Zea mays
  misc_feature: Ceres CLONE 1426469-F
  misc_feature: Encodes the peptide sequence at SEQ ID NO. 38386
aagctggagctccccgcggtggcggccgctctagaactagtggatcccccgggctgcaggaattcgcacgagaccattacctagaacatcctaatcgaaaaacaggctcatctcgctttggatctattggtttcgtaactggtgagggactgagggtctccgagtggattgatttgggattctgttcgaagatttgcggaggggggcaatggcaaccgcggggaaggtgatcaagtgcaaagctgcggtggcatgggaggccggcaagccactgtcgatcgaagaggtggaggtagcgcctccgcaagccatggaggtgcgcatcaagatcctcttcacctcgctctgccacaccgacgtctacttctgggaggccaaggggcacactcccgtgttccctcggatctttggccacgaggctggaggtatcatagagagtgttggagagggtgtgactgacgtagctccgggcgaccatgtccttcctgtgttcactggggagcgcaaggagtgtgccctctgctagtctgcagagagcaacatgtgtgatctgctcaggatcaacaccgaccgcagtgtgatgattgccgatggcaagtctctgctttcaatcaatgtgaagcctatctaccacttgtgtgggacttccaccttcagcgagtacaccgtcatgcatgtggggttgtgtagcacagatcagcc

SEQ ID NO: 38386 - protein, 105 aa, Zea mays
  misc_feature: Ceres CLONE 1426469-F
  misc_feature (34)..(105): Pfam Name: ADH_N Pfam Description: Alcohol dehydrogenase GroES-like domain
  misc_feature: SWISSPROT Homolog: EC 1.1.1.1 Alcohol dehydrogenase
MATAGKVIKCKAAVAWEAGKPLSIEEVEVAPPQAMEVRIKILFTSLCHTDVYFWEAKGHTPVFPRIFGHEAGGIIESVGEGVTDVAPGDHVLPVFTGERKECALC

SEQ ID NO: 38387 - DNA, 635 bp, Zea mays
  misc_feature: Ceres CLONE 1426472-F
  misc_feature: Encodes the peptide sequence at SEQ ID NO. 38388
  misc_feature (150)..(150): n is a, c, t, g, unknown, or other
  misc_feature (158)..(158): n is a, c, t, g, unknown, or other
  misc_feature (159)..(159): n is a, c, t, g, unknown, or other
  misc_feature (184)..(184): n is a, c, t, g, unknown, or other
  misc_feature (218)..(218): n is a, c, t, g, unknown, or other
  misc_feature (230)..(230): n is a, c, t, g, unknown, or other
  misc_feature (231)..(231): n is a, c, t, g, unknown, or other
  misc_feature (244)..(244): n is a, c, t, g, unknown, or other
  misc_feature (250)..(250): n is a, c, t, g, unknown, or other
  misc_feature (272)..(272): n is a, c, t, g, unknown, or other
  misc_feature (351)..(351): n is a, c, t, g, unknown, or other
ctggagctccccgcggtggcggccgctctagaactagtggatcccccgggctgcaggaattcgcacgagaccattacctagaacatcctaatcgaaaaacctcagcacaacactctccccagctcgagtaaccacagcgagaaccaatcngcaagcannaagccccgagaaagaagaacaaacnggagacacagatgggcgctgcagcgaaagcgtcntggatggtggcnnatgagcgtcgggnccgtgnaagcgctcaaggacaagcgggncctgtgccgctggaactacggggtggggttcggtcaaccgggccgcaaaggcaaaggttccaattttcccgcaagcaangaaactggggcccccccccccccgaaaaaagcccccccgcaagaagggaataaagacccccccttttccctaacctgtggggggccctaaaaaaaaaggggccctcgcgaatttttcggtttctcgaaaccatacaaaagatcggggttaaaaataaaaacacaaagggggtggcctcccggcccccccttgtaaaaatggggaaattccccccccccataaaagaatgaaaaaaatcccccccccttttttttttttctcccaaaaattggaacccccccccc

SEQ ID NO: 38388 - protein, 69 aa, Zea mays
  misc_feature: Ceres CLONE 1426472-F
  misc_feature (5)..(5): Xaa is any aa, unknown, or other
  misc_feature (7)..(7): Xaa is any aa, unknown, or other
  misc_feature (14)..(14): Xaa is any aa, unknown, or other
  misc_feature (40)..(40): Xaa is any aa, unknown, or other
MSVGXVXALKDKRXLCRWNYGVGFGQPGRKGKGSNFPASXETGAPPPPKKAPPQEGNKDPPFSLTCGGP

SEQ ID NO: 38389 - DNA, 700 bp, Zea mays
  misc_feature: Ceres CLONE 1426480-F
  misc_feature: Encodes the peptide sequence at SEQ ID NO. 38390
ggagctccccgcggtggcggccgctctagaactagtggatcccccgggctgcaggaattcgcacgagaccattacctagaacatcctaatcgaaaagccacattttacatcccaccaccagcctccttcccctttccgttccccgaagcgagagcgaagccagcgcccatcttcttcttcctcctccttgttgttggatcgcagctccttcgtcgtagcgtccgatacgccaggtttcctttcgcgagcaacaatctttggcaatggcgtccacgtcgagctcgacgccagcgccggttgaggtggacgagaggggccggaagcggaagcgtgcggccggggcggaccccgcggcgccggcgcagccgtccaagtggcggacgcggcgcgagcacgacatctactcgtccaagctcctggaggcgatccgcctcgtgcgcgcggggaccccctccgccgccgccgccgggactgcggcggtcccgacgcacaacaaggtcgtgcacgaggcggccgaccgtgccctcgctgacggggcgcgcgggcgcactatctggactggcgccatcctcgagtccagccgccacaacgtctcgaccgcgcaccagcaagggcgtccaagcccccaagacggcccccgagcgacctaataacgcctcgaccgactgtgcgaagggatctgatgctcagcatctggtgg

SEQ ID NO: 38390 - protein, 128 aa, Zea mays
  misc_feature: Ceres CLONE 1426480-F
MASTSSSTPAPVEVDERGRKRKRAAGADPAAPAQPSKWRTRREHDIYSSKLLEAIRLVRAGTPSAAAAGTAAVPTHNKVVHEAADRALADGARGRTIWTGAILESSRHNVSTAHQQGRPSPQDGPRAT

SEQ ID NO: 38391 - DNA, 629 bp, Zea mays
  misc_feature: Ceres CLONE 1426481-F
  misc_feature: Encodes the peptide sequence at SEQ ID NO. 38392
aaagctggagctccccgcggtggcggccgctctagaactagtggatcccccgggctgcaggaattcgcacgagaccattacctagaacatcctaatcgaaaaatcccatcccctcaggcctcagtcgtcagtccctcacacactcactatacactgctctgctggagcaagaaggaagaagctagcgcctccctagctctcgatgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctactacctgacgtccttccggttcacccccatcaaggagtccatcgtgtcacgcgagatgacccggcgctacatgacggacatgatcacccacgccgacaccgacgtggtgatcgtgggcgccgggtccgcgggcctgtcctgcgcgtaccagctgtccaaggacccctccgagagcgtcgccatcgtggagcagtcagtgtccccagccggctgcgcgtggctgggcggccagctgttctcggccatggaggcgc

SEQ ID NO: 38392 - protein, 139 aa, Zea mays
  misc_feature: Ceres CLONE 1426481-F
  misc_feature (62)..(139): Pfam Name: Thi4 Pfam Description: Thi4 family
  misc_feature: SWISSPROT Homolog: EC 1.1.99.1 Choline dehydrogenase
MATTAASSLLKSSFAGSRLPSATRTTTPSSVAVATPRAGGGPIRASISSSPTPPYYLTSFRFTPIKESIVSREMTRRYMTDMITHADTDVVIVGAGSAGLSCAYQLSKDPSESVAIVEQSVSPAGCAWLGGQLFSAMEA

SEQ ID NO: 38393 - DNA, 650 bp, Zea mays
  misc_feature: Ceres CLONE 1426494-F
  misc_feature (199)..(199): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (313)..(313): n is a, c, t, g, unknown, or other
  misc_feature (315)..(315): n is a, c, t, g, unknown, or other
  misc_feature (316)..(316): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (335)..(335): n is a, c, t, g, unknown, or other
  misc_feature (338)..(338): n is a, c, t, g, unknown, or other
  misc_feature (339)..(339): n is a, c, t, g, unknown, or other
  misc_feature (427)..(427): n is a, c, t, g, unknown, or other
  misc_feature (437)..(437): n is a, c, t, g, unknown, or other
  misc_feature (438)..(438): n is a, c, t, g, unknown, or other
  misc_feature (487)..(487): n is a, c, t, g, unknown, or other
  misc_feature (539)..(539): n is a, c, t, g, unknown, or other
  misc_feature (573)..(573): n is a, c, t, g, unknown, or other
  misc_feature (626)..(626): n is a, c, t, g, unknown, or other
aaactggagctctccccggtggcggccgctctagaatagtggatcccccgggctgctggagttcgcacgagaccattacctagaacatcctaatcgaaaaccaccaccactggacgtcagcctagcaattagctcatcgactccagattggagaactcgacaccatgaaggtgctgatggttgcccttgctctcctggnannnnnnttgttctgcctcctcgacgcacccataaacgggtgtggctgccagacaccaccgtttcatcttaccccctcccgctctataatgcccgccccccccctttccttttngnnggcgnnnctccctcgcggnagnnattggcccaccccccactcacccacgaagctaagcccgtgccaggcagtttcgattcctgcgcggtcggcagcgtccggcagccgttncctggggcanntgccgtcgagttcctggaaggcaccagtgcagccccggcgcgacgcccntacggctcgccacagtgccagcgcttgcagcacagtgctgccaccagatcanggcagtgagccgctgcacgtaccagcgacatacngtgtggtcctgcatccttctgcacacagcgcaggcagctcgcgcctgatggcngccagtagccacactggacgcgag

SEQ ID NO: 38394 - DNA, 645 bp, Zea mays
  misc_feature: Ceres CLONE 1426504-F
  misc_feature: Translation starting site: 264
aaaactggagctccccgcggtggcggccgctctagaactagtggatcccccgggctgcaggaattcgcacgagaccattacctagaacatcctaatcgaaaaatcccaatcgtagtcatagctcaagaatcaccggcaggagctctgggcagcgtgcgcacgtggggtacctagctcgctctgctagcctaccatggctgatcaccaccggggagcgacgggaggtggcaggagctacggcgactctccagcgcgggggcagtatgcacggcaaggcccagaatcagcagaagcatggcgccatgatgacggcgctcaacgccgcgacggccgcgaccttcggcgggtcgatgctggtgctgtccgggctgatcctggccggcaccgtgatcgctctcacggtggccacccccgagctggtgatcttcagcccggtgctggtgccagccgccatcgcactggcgctcatgacagcctggttcctcatctccggaagacacgacgacgctgctctatccgtgatctcatggataacaagtacgtgactggcaagcacccgacgggcatcgaccagctggaccacacccaggcgaggatggtgtccaacgttcaatacatcaaggatgcagcacatcaccgcatcaa

SEQ ID NO: 38395 - DNA, 713 bp, Zea mays
  misc_feature: Ceres CLONE 1426505-F
  misc_feature: Encodes the peptide sequence at SEQ ID NO. 38396
aaagctggagctccccgcggtggcggccgctctagaactagtggatcccccgggctgcaggaattcgcacgagaccattacctagaacatcctaatcgaaaacactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcaacagcagcagggaggaggcaggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacaccggtgttcctgatcttcagccccgtgctcgtccccgccgcgctgctcatcgggacggccgtcatggggttcctcacgtcgggcgcgctggggctcgggggcctgtcctcgctcacgtgcctcacacacacggcgcggcatgcgttccagcgcaccccggactacgtgggagacgcgcaccgcacgatggcggacgtcgctgcgcacgcatgccacaataccgcgcatgcacgccagtgcattcagggtaggccgcaggaagcctgtcccgggggaggt

SEQ ID NO: 38396 - protein, 173 aa, Zea mays
  misc_feature: Ceres CLONE 1426505-F
  misc_feature (44)..(161): Pfam Name: Oleosin Pfam Description: Oleosin
MADRDRSGIYGGAHATYGQQQQQGGGRRPMGEQVKGMLHDKGPTASQALTVVTLFPLGGLLLVLSGLALTASVVGLAVATPVFLIFSPVLVPAALLIGTAVMGFLTSGALGLGGLSSLTCLTHTARHAFQRTPDYVGDAHRTMADVAAHACHNTAHARQCIQGRPQEACPGGG

SEQ ID NO: 38397 - DNA, 668 bp, Zea mays
  misc_feature: Ceres CLONE 1426514-F
  misc_feature: Encodes the peptide sequence at SEQ ID NO. 38398
tggagctccccgcggtggcggccgctctagaactagtggatcccccgggctgcaggaattcgcacgagaccattacctagaacatcctaatcgaaaagtcacctttcccaccacctgtcctcccccgcgtctgcttctctcctcggccccgaggcatggcgccctgcgcgtccccgtccgccctcgcgctctccgccagcacgcgggtcagcagcttcccactgacgctgcggctggaggcgcgtgtggcgcgcgcgcccggcagcgcccagctccgcccggcgaccgcgtgctcttggccgcgccccttgctgcccgagctcgcgccggcgtttcctcgcgccggcgcccgcagcgccggcagaccgcagccgctgtttccgaccacgcgcaatgatgacgacgtctcagatcgccagctgcgccttccaccgtgggcacggtcggcgtcctccccttcttaccgctcatgggcctcggccccaacgccgaactccacaaacgcacggtggaaagaaacgccccctatagttccctatggcttctctacacctaactggtctaactgggttggaaccccgaaaccctttgcgccctgttcccgagacaatactgggtcccccaaatgtccggatcttcaggatagttcccgaaagagaataccctcc

SEQ ID NO: 38398 - protein, 171 aa, Zea mays
  misc_feature: Ceres CLONE 1426514-F
MAPCASPSALALSASTRVSSFPLTLRLEARVARAPGSAQLRPATACSWPRPLLPELAPAFPRAGARSAGRPQPLFPTTRNDDDVSDRQLRLPPWARSASSPSYRSWASAPTPNSTNARWKETPPIVPYGFSTPNWSNWVGTPKPFAPCSRDNTGSPKCPDLQDSSRKRIPS

SEQ ID NO: 38399 - DNA, 597 bp, Zea mays
  misc_feature: Ceres CLONE 1426521-F
  misc_feature (306)..(306): n is a, c, t, g, unknown, or other
aaagctggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgnccgtggcccgctgtgcatcctcccaaatccttttcttcccccggcaaaacgcggggcttggggggaaatatattttccaaaggggggatttttaaacccccggggggttttaacccccccccccaaaagaaaaccccctttgtggggcgggggaggggcttcttcttcgcgcaaaaaaggagttggtggcccccaagggggggcggcccccccccttttttttttctttggggggggggaaaaaaaaaaaaaaaaaaaatttttttttgggggggggggggaatttttttt

SEQ ID NO: 38400 - DNA, 662 bp, Zea mays; identical to SEQ ID NO: 38232
  misc_feature: Ceres CLONE 1426526-F
  misc_feature: Encodes the peptide sequence at SEQ ID NO. 38401

SEQ ID NO: 38401 - protein, 142 aa, Zea mays; identical to SEQ ID NO: 38233
  misc_feature: Ceres CLONE 1426526-F

SEQ ID NO: 38402 - DNA, 654 bp, Zea mays
  misc_feature: Ceres CLONE 1426532-F
  misc_feature: Encodes the peptide sequence at SEQ ID NO. 38403
aaagctggagctccccgcggtggcggccgctctagaactagtggatcccccgggctgcaggaattcgcacgagaccattacctagaacatcctaatcgaaaaacagtgcctctcgctcactgactgactactgtaataccagagatcgaacaacttggccctgcagctcaagaagatagttttgtgcatttgggggccgggggcaagacatagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcaccgccatcacggaggccgatctatacaagattgagccatgtgacctcccgagcaaggcgaagatgggcgagaaagagtggtacttcttctaccagaaggaccgcaagtacccgacggggctgagggcgaaacgggccaccagagccggttactgtaaggcgactggcaatgacaaggaggtctacaacgccgcggaaggagtggcggtactggtcggcatgaagaatacgctcgtcttctacaggtgcagggctcccaggggtgacaagacaaa

SEQ ID NO: 38403 - protein, 143 aa, Zea mays
  misc_feature: Ceres CLONE 1426532-F
  misc_feature (23)..(143): Pfam Name: NAM Pfam Description: No apical meristem (NAM) protein
MAADQQPQLQEEMNDAAGGGLRLPPGFRFHPSDFEIVSFYLTNKVLNTRFTCTAITEADLYKIEPCDLPSKAKMGEKEWYFFYQKDRKYPTGLRAKRATRAGYCKATGNDKEVYNAAEGVAVLVGMKNTLVFYRCRAPRGDKT

SEQ ID NO: 38404 - DNA, 666 bp, Zea mays
  misc_feature: Ceres CLONE 1426539-F
  misc_feature: Encodes the peptide sequence at SEQ ID NO. 38405
tggagctccccgcggtggcggccgctctagaactagtggatcccccgggctgcaggaattcgcacgagaccattacctagaacatcctaatcgaaaaagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagaggtccgtaccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcagagaccacttcccgtcttcctcccgtggcctgtctgtcatctggctctgaaacgatggcagtcctgcaagttgctgctgctgccc

SEQ ID NO: 38405 - protein, 51 aa, Zea mays; identical to SEQ ID NO: 13325
  misc_feature: Ceres CLONE 1426539-F
  misc_feature (1)..(51): Pfam Name: AdoMetDC_leader Pfam Description: S-adenosyl-l-methionine decarboxylase leader peptide

SEQ ID NO: 38406 - DNA, 639 bp, Zea mays
  misc_feature: Ceres CLONE 1426542-F
  misc_feature: Encodes the peptide sequence at SEQ ID NO. 38407
aagctggagctccccgcggtggcggccgctctagaactagtggatcccccgggctgcaggaattcgcacgagaccattacctagaacatcataatcgaaaatttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcgtcggcgcggggcgcctcgccgacgccgcctcctccggccgcgcgtcccccgccggcgcagcttttcaactggccgggcgcccaccagccgcagctcttcccgcccggtccgggcgcgttccaccacccgtcggcgcgggcgatgccgccattgttcccaggcggcggcaaggacgagggccacatgttccacattccaccggcacaccatggcagcaagccactgcacatggacgagctccagcaccggcaccagcagacgatgggggccggtggcgaggcgcccgacggtgaactccggtggcccaacgggctgtccttcttcaccgcgctcaccgggcgaga

SEQ ID NO: 38407 - protein, 135 aa, Zea mays
  misc_feature: Ceres CLONE 1426542-F
MRHTFESLGYQSGFFLSQLFSSARGASPTPPPPAARPPPAQLFNWPGAHQPQLFPPGPGAFHHPSARAMPPLFPGGGKDEGHMFHIPPAHHGSKPLHMDELQHRHQQTMGAGGEAPDGELRWPNGLSFFTALTGR

SEQ ID NO: 38408 - DNA, 668 bp, Zea mays
  misc_feature: Ceres CLONE 1426543-F
  misc_feature (410)..(410): n is a, c, t, g, unknown, or other
  misc_feature (411)..(411): n is a, c, t, g, unknown, or other
  misc_feature (416)..(416): n is a, c, t, g, unknown, or other
  misc_feature (426)..(426): n is a, c, t, g, unknown, or other
  misc_feature (428)..(428): n is a, c, t, g, unknown, or other
  misc_feature (437)..(437): n is a, c, t, g, unknown, or other
  misc_feature (462)..(462): n is a, c, t, g, unknown, or other
  misc_feature (477)..(477): n is a, c, t, g, unknown, or other
  misc_feature (486)..(486): n is a, c, t, g, unknown, or other
  misc_feature (487)..(487): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (550)..(550): n is a, c, t, g, unknown, or other
  misc_feature (566)..(566): n is a, c, t, g, unknown, or other
  misc_feature (576)..(576): n is a, c, t, g, unknown, or other
  misc_feature (581)..(581): n is a, c, t, g, unknown, or other
  misc_feature (582)..(582): n is a, c, t, g, unknown, or other
ggagctcaccgcggtggcggccgctctagaactagtggatcccccgggctgcaggaattcgcacgagaccattacctagaacatcctaatcgaaaaatcctcggcccgtctcctttcgaaatttttcacccggcttctgctcgcctgcgagacgccgcgaccgccatcaccctctcgggtttctcggacgcgccgccataacctctccaccgatcacaggttcgttggatcgacgcatccgtccccacccgccggccagagaaggagacctgcttctcccccaacgcgaacaacaccaggcaccgttttccgcgccaatggcggggtcgccgtcacctcgcgttgagccagacgcccaggtttgagacgaagctgtcacacgtcaggagctcgtgtctttgtcccccccnntgccnaatcttcatngnggccttcanaagatgggagcgcacaggagaatantgcggctgtttcttnttggcggtnngttgnnnnggcttaagaaccgggcatcgccatggagacgagactctttatcacccttaagggnatgaagtggaccatgntgaaggtganctctnnaatgaggaccagcaacaagtggatgtgtgtgcgtcgtgccaacaagcgacagacttctccttctgccaaagccaaggggttgtccg

SEQ ID NO: 38409 - DNA, 655 bp, Zea mays
  misc_feature: Ceres CLONE 1426546-F
  misc_feature: Encodes the peptide sequence at SEQ ID NO. 38410
aaagctggagctccccgcggtggcggccgctctattaactagtggatcccccgggctgcaggaattcgcacgagaccattacctagaacatcctaatcgaaaaacgatcacactccactccacaggattatttagagggatagagtaaggccactcactctcacacaccactaggctagcctagccttttagtcgtcgaggaggagcaagaggggcgcgcactctagcaggatatcttgatgagagccgatcgaccgaaagctagtacgccatggctaggtcttccaatatgatggtggcggcagctctgctggtcttggccctggccgtgtcgatcgccgaggcgaggaacatcttgaccacgacgacgtagaataaggacgacgcggtggtgcatccgcataccttcccgccctcccaccgcctcggtggctgcgcgtccccggcgttcggctgcctccccggcggccgcattcctggcagcagcattcccgggttcagcatgcccggcagcggcagcagcctaccctggttctgcttgctcggcagtggcagcatgcccctcttcggcggtggatccccgggcttcacctgcttcagcggcatgccggggtcctccaccgccggctccttccacgatcacgccaacatgccc

SEQ ID NO: 38410 - protein, 51 aa, Zea mays
  misc_feature: Ceres CLONE 1426546-F
MPGSGSSLPWFCLLGSGSMPLFGGGSPGFTCFSGMPGSSTAGSFHDHANMP

SEQ ID NO: 38411 - DNA, 635 bp, Zea mays
  misc_feature: Ceres CLONE 1426550-F
  misc_feature: Translation starting site: 241
  misc_feature (434)..(434): n is a, c, t, g, unknown, or other
  misc_feature (457)..(457): n is a, c, t, g, unknown, or other
  misc_feature (488)..(488): n is a, c, t, g, unknown, or other
  misc_feature (528)..(528): n is a, c, t, g, unknown, or other
aagctggagctccccgcggtggcggccgctctagaactagtggatcccccgggctgcaggaattcgcacgagaccattacctagaacatcctaatcgaaaaaccatatctcgaggcaccggagtccggggacgccgttctttccgttgtgcttcctttgcctcttgctgccggtggccggtgattttcccgaggtctgtttgggcggcaggtagaggctattttcttggcggctggtgggatggatagcctcgccgccgggtcgagctccggcgggtccggtgatggcagcacgcagcccaggaggagctccaggaaacccacttattccaagtttactcagacaggagctaacatgcttgcaagccgattcttactccaagatgagttatttcagtattcgttcttagtggcgtcatttttgtctcgagtganattgatcccctgcgagcttcacngaccgttgtcgagatcgttgacggggatgangatgcatgtgtcctgctggtgtgactgacagcttgctacntcgggaatgtagctctaccaaaaggtggtcccggatttgacgatgccccggagttaccccgctatttggggttttaggtcgggaagatttcccaaaccaaaggggtt

SEQ ID NO: 38412 - DNA, 656 bp, Zea mays
  misc_feature: Ceres CLONE 1426551-F
  misc_feature: Encodes the peptide sequence at SEQ ID NO. 38413
aaagctggagctccccgcggtggcggccgctctagaactagtggatcccccgggctgcaggaattcgcacgagaccattacctagaacatcctaatcgaaaagcaacgattacggtaacgccgtcgccgccctacggctcacatcttcgtcgtcatcttctccggcaacgagcacccaaggatggtggtccttcaaccagatcggttcctgaacgagctgaccagcatgtacgagcggagcacgtacaacggctccgtctgggtcaccatgaagcgatcaactctcaagggcaaggcacaattgcggaagatggagaataacgggcaggaggtagagcacaggtgcctcgtccacgcctccaatggtaataagaacatctccacctcggtttctctaaaggagtacacaaagttacaagcttcatacgcaacatttcttaaggcccatatgcatgctctgaagaaaagggagaggtaagacaagaagagcgctgcatatgctgagaaggcaattgagaccgcacccaagaagcagaagagagcatcttcaaagacatcttcggggtccaagtcataaggcgctcgcagagatcactgtcttctcccttctgatgttaccgcaccgccagactaattagagtgacgctgattttatc

SEQ ID NO: 38413 - protein, 98 aa, Zea mays
  misc_feature: Ceres CLONE 1426551-F
  misc_feature (4)..(93): Pfam Name: SRP14 Pfam Description: Signal recognition particle 14kD protein
MVVLQPDRFLNELTSMYERSTYNGSVWVTMKRSTLKGKAQLRKMENNGQEVEHRCLVHASNGNKNISTSVSLKEYTKLQASYATFLKAHMHALKKRER

SEQ ID NO: 38414 - DNA, 685 bp, Zea mays
  misc_feature: Ceres CLONE 1426558-F
  misc_feature: Encodes the peptide sequence at SEQ ID NO. 38415
ggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtccgtctgctggatcgtattccgatgggtgatttgagcgtctgggttgtcacccgcgcgcccgaaggcaacccgtttgcggcggcgatggagctgcctcatcacgcgcacaaagaagctatggggccccaaacaaggtcaaggttctccccctctttctttgacttctcgcatgggggggaacagataaaaaaaagcgcactccctgtggtccccggggggattctccttctttgggcaacagcaccccaaccccttttgtttccattttctgaatatgaaaaagggcgccccgggaatttaaaagtgcgggggggttggggggcacaaaaattatcgcgg

SEQ ID NO: 38415 - protein, 29 aa, Zea mays
  misc_feature: Ceres CLONE 1426558-F
MAVQAHYHHHYHRESPFLVRYLPWPLCIF

SEQ ID NO: 38416 - DNA, 626 bp, Zea mays
  misc_feature: Ceres CLONE 1426561-F
  misc_feature: Translation starting site: 227
  misc_feature (388)..(388): n is a, c, t, g, unknown, or other
ggagctccccgcggtggcggccgctctagaactagtggatcccccgggctgcaggaattcgcacgagaccattacctagaacatcctaatcgaaaaaaggcaactcagccaagctcgtgagagcagaggaactctctttcctcacactccaaagcagcaagaccatctggcaaagctgcgctagaggccagcatcaggccataataggccagagagcagacgaggcatggcgacgtccgtggcctgcgccttcttcttcttcgacgcggcggagccgctgggcgagggcgggcggcggcggcagcggcaagcgctggacgcctgcgcgctctgctccaagccgctggcccgcaacagcgacatcttcatgtacaggggcgacaccccngttctgcagcgaggactgccgctacgagcagatgcaccacgacgcggcggccacggcctacgcgcggcatcaggccagcagccggcggaggcagcagcggagcagggggcggctctgtgtccgccaacgaggcgggacgtgtacgtgggccagctagagtaagaacaagcgcaaattgcaaacccccgcaagccccaaaaaggtaaaggcctgccctcctgttcacaaaaaaatccgc

SEQ ID NO: 38417 - DNA, 648 bp, Zea mays
  misc_feature: Ceres CLONE 1426562-F
  misc_feature: Translation starting site: 156
aaagctggactccccgcggtggcggccgctctagaactagtggatcccccgggctgcaggattcgcacgagaccattacctagaacatcctaatcgaaaaatcacacattttattgagacaactagcaacctaaaaagcctatagtgtaccaacaatggccgccaaaatattttgcctccttatgcacctagatatttctgcaagtgttgttactgtcaccattttcctgaaatggtcgcaagctcctataccttaccttcttcacccgtacctctcatcagcggtgtcttcggtaagtgaaaacccaatccttcaaccctacaggatccaacaggtaatcgcagctggcatcttacctttatcacccttgtacctccaacaatcatcagccctattacaacacttaccttaggtgcatttattggcacaaaacatacatggcacaacaactacaacaacatgtgctaccaaacattgctgcctactctcaccaacagcagtttcttccattcaaccaactacgttcattgaactctacttcttatttgcaacaacaacaactactattcaaccagctacatggtgcctaacctcagcaatttcttccattcaaccaactggcagcattgaactctcctgcttatttc

SEQ ID NO: 38418 - DNA, 638 bp, Zea mays
  misc_feature: Ceres CLONE 1426564-F
  misc_feature: Encodes the peptide sequence at SEQ ID NO. 38419
  misc_feature (466)..(466): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaagacgctcgaagcctctcctcgtctcctcccccacccgtccatcgcccctccctccggtctgcgctcccacagcctcacccctgcgcccccgccgattcgcatcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagagatccttcgcgcagcagcactacgctgacctttccgacaagcctttcttccccgggttggtggagtacatcatttccggccccgtgatggcaatggtgtgggaggagaaggacttcntgttgactggccgtaggatcattggggccaccaggccttgggaggcagcccccgtgtacattcgtggggactacgccgtggaagtcggcaggcgaacatccctttctttgtactcgatcagttgtgctttgctgcgaatgttttagtttggacactttaataaccatgctcn

SEQ ID NO: 38419 - protein, 128 aa, Zea mays
  misc_feature: Ceres CLONE 1426564-F
  misc_feature (2)..(120): Pfam Name: NDK Pfam Description: Nucleoside diphosphate kinase
  misc_feature: SWISSPROT Homolog: EC 2.7.4.6 Nucleoside-diphosphate kinase
  misc_feature (81)..(81): Xaa is any aa, unknown, or other
MEQTFIMIKPDGVQRGLIGDIISRFEKKGFYLKGMKFMNVERSFAQQHYADLSDKPFFPGLVEYIISGPVMAMVWEEKDFXLTGRRIIGATRPWEAAPVYIRGDYAVEVGRRTSLSLYSISCALLRMF

SEQ ID NO: 38420 - DNA, 639 bp, Zea mays
  misc_feature: Ceres CLONE 1426567-F
  misc_feature: Encodes the peptide sequence at SEQ ID NO. 38421
aaagctggagctccccgcggtggcggccgctctagaactagtggatcccccgggctgcaggaattcgcacgagaccattacctagaacatcctaatcgaaaaacaacaacgagttaacgaaagccttttatccaagctcaggaaagctcacagtttcgttggatccaatcttagttttatccaagctcagcaatggcttctcgtcagcagcatcctactagctaccacgccggcgagacaaaggcccgtgccgaggagaagacgggtcaagtgatgggggcggcgcaggagaaagggagggaggccaagcacaaggcgtccgacgccgccgaccgcgccatggggatgggccacgacgccagggaggcgaccagggagaaggcgcgcgccgccgcggaccgaaccatggggatgggccacgacgccggggagacggccaaggacagggcgtaccgggccaaggacgcggcctccggtgccgctgtccgcgccagggacactgcgtccgacgcggccggcgctgccggggaccgcgcccacgacggcgcgcagcagaccgggagctacgtcgcgcagacggccgaggccgccaggcagaaggcggccggcgccgcgctgtacgccaaggacaccgtggtg

SEQ ID NO: 38421 - protein, 149 aa, Zea mays
  misc_feature: Ceres CLONE 1426567-F
MASRQQHPTSYHAGETKARAEEKTGQVMGAAQEKGREAKHKASDAADRAMGMGHDAREATREKARAAADRTMGMGHDAGETAKDRAYRAKDAASGAAVRARDTASDAAGAAGDRAHDGAQQTGSYVAQTAEAARQKAAGAALYAKDTVV

SEQ ID NO: 38422 - DNA, 657 bp, Zea mays
  misc_feature: Ceres CLONE 1426571-F
  misc_feature: Encodes the peptide sequence at SEQ ID NO. 38423
aaactggagctccccgcggtggcggccgctctagaactagtggatcccccgggctgcaggaattcgcacgagaccattacctagaacatcctaatcgaaaaatatgccgctcccctacctctccagcatctcccgtctccgtcgtctcgtctctgctcctcacctcgccgcctgccatgggcaagatcaagatcggaatctacggtttcggaaggatcggcaggctcgtggccagggtcgccctgcagagcgaggatgtctagctcgtcgccgtcaacgaccccttcatcaccacggattacatgacctacatgttcaagtactacaccgtgcacggccaatggaagcacagcgacatcaccctcaaggactccaagacgcttctcttcggcgagaagccggtcaccgtctttggcatcagggaccccgatgagatcccgtggggtgaggctggtgctgactatgtcgtggagtccaccggtgtcttcactgacaaggacaaggctgctgcacatctgaacggtggtgccaagaaggttgttatctctgccccaagcgaagatgcacccatgtttgctgttggtgtcaatgaggacaagtacacctccgatgttaacattgtttccaatgctagctgcaccacagactgccttgctc

SEQ ID NO: 38423 - protein, 118 aa, Zea mays
  misc_feature: Ceres CLONE 1426571-F
  misc_feature (1)..(112): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MTYMFKYYTVHGQWKHSDITLKDSKTLLFGEKPVTVFGIRDPDEIPWGEAGADYVVESTGVFTDKDKAAAHLNGGAKKVVISAPSEDAPMFAVGVNEDKYTSDVNIVSNASCTTDCLA

SEQ ID NO: 38424 - DNA, 619 bp, Zea mays
  misc_feature: Ceres CLONE 1426575-F
  misc_feature: Encodes the peptide sequence at SEQ ID NO. 38425
aaagctggagctccccgcggtggcggccgctctagaactagtggatcccccgggctgcaggaattcgcacgagaccattacctagaacatcctaatcgaaaaaactgagaaccgcacagacaggcgtcttcgtactcgcctatctccgcgacccaaagcgttcccccttctcccattcttctctgatttctcaccaccgccgccgctaccccctttcgacaacaccatgagggagtgcatctcgatccacatcggccaggccggtatccaggtcggaaacgcgtgctgggagctgtactgcctcgagcatggaattcaggctgatggtcagatgcccggtgacaagaccattgggggaggtgatgatgctttcaacaccttcttcagtgagacatggcgctggcaagcacgtcccccgtgctgtttttgttgaccttgaccccactgacatcgatgacgtgaggactggcacctatcgccagctcttccatcctgagcagctcatcagtggcaaggaggatgcagccaacaacttcgctcgtggtcactacaccattggcaatgagattgttgacctgtgccttgaccgcatcaagaagcttgcagataactgcactgg

SEQ ID NO: 38425 - protein, 103 aa, Zea mays
  misc_feature: Ceres CLONE 1426575-F
MEFRLMVRCPVTRPLGEVMMLSTPSSVRHGAGKHVPRAVFVDLDPTDIDDVRTGTYRQLFHPEQLISGKEDAANNFARGHYTIGNEIVDLCLDRIKKLADNCT

SEQ ID NO: 38426 - DNA, 652 bp, Zea mays
  misc_feature: Ceres CLONE 1426576-F
  misc_feature: Encodes the peptide sequence at SEQ ID NO. 38427
aagctggagctccccgcggtggcggccgctctagaactagtggatcccccgggctgcaggaattcgcacgagaccattacctagaacatcctaatcgaaaaatcagtcctgtccaccagcaccgccaccacactcgccgaccggcaatgaaccacggcggcggcgggaggagcagcagccggctccgggaccggctggcccggatgttccgcccgagcgcgctgctccgctccacctgcaacacggccgccgccgcatcctcctgctcctcctcgtctcccgcgtccacggccaagcctccgcctccgcctgtggctgcggcggcctccgcgtgctcctccagccgcgcgctgctcggcgccgtcgtcgacggggactcgtcgttcctcgcctcctcgcggcgcgacctcgccgtcgccggccgcgccgagtccttctccgccgccgtggaccgccggcgccgcagccgcagcagcagcctggacgcggtggcgccgccgccctcccgcttctccgtcgacgcgccggcgggtctggcggagacgggcccggacaaggctggagaggaagaggattatgagagcccgcgcgacgacgacgacgacgagcaccggctccgtgtccgtggcagcagctagaacgacagctggat

SEQ ID NO: 38427 - protein, 163 aa, Zea mays
  misc_feature: Ceres CLONE 1426576-F
MNHGGGGRSSSRLRDRLARMFRPSALLRSTCNTAAAASSCSSSSPASTAKPPPPPVAAAASACSSSRALLGAVVDGDSSFLASSRRDLAVAGRAESFSAAVDRRRRSRSSSLDAVAPPPSRFSVDAPAGLAETGPDKAGEEEDYESPRDDDDDEHRLRVRGSS

SEQ ID NO: 38428 - DNA, 648 bp, Zea mays
  misc_feature: Ceres CLONE 1426584-F
aagctggagctccccgcggtggcggccgctctagaactagtggatcccccgggctgcaggaattcgcacgagaccattacctagaacatcctaatccaaaaaaacggtaaaggcacagcaaaaaatagagtatcacctactcatgcgggctctgcctgtattccatatttgcattcccagggacaaaaacacccagcaccgactttggtacctattagttggacgccctgcacatggtcgactcgatccgtctatctaccaacagaccggcccgccactcactagaagttgtgtggcgggtctcaatcctacacccgatgatgcttctaactacactgcaagacaatggcgacgaatggcacagcctttcatgtgctcgggacggactgtgatgtcacttccggcactctgcccgactagctgttgctgtacaccacctactgcttccctacagcggctccaatacttgcacggatatgtgcaggtgcttgcatgccaccatcatctccaccgcttgcccaggcatactgatctccgtccccagcgcccgcgacatcaccatcctcagctcgtcggccaccacaacctcccgccacagctcggacttgaaactgtccagcggcccgtccacctctgcgtccgcggctc

SEQ ID NO: 38429 - DNA, 648 bp, Zea mays
  misc_feature: Ceres CLONE 1426585-F
aagctggagctccccgcggtggcggccgctctagaactagtggatcccccgggctgcaggaattcgcacgagaccattacctagaacatcctaatcgaaaaatttaatttaaagaccgctactctgcctgccggaattgaccgcagccttcattcctccaggtccccgatagcacttctgcctccgcgagggaggcggatcccttcactcgcctggcaagcgctacacgagggaatggagtgcggtctctcaacccgcacctcccgggccgtcgatcagtcgatttccgacagtctgtctcgtcactcactcacatcgagtgtcaagatctatcagcacatttctcccatgccgattgtctgtcacagtgtccctcagcgcggacaatgccgcgcttctctgacaacgagtttactaggatacatcagatgacactcgatttggactgactataacgttggcttttgcttcatcttcactgactttatgcacattgcataatgtggcactgatgacatctcttctgaagtgacggcctagcatttggtcgtatactacagagtcctgagatggagtcgtaattatcggaagagatatgttcaaggctcaaccgtacagaaaactgatgatgccccctgtaatgcctgc

SEQ ID NO: 38430 - DNA, 629 bp, Zea mays
  misc_feature: Ceres CLONE 1426601-F
  misc_feature (392)..(392): n is a, c, t, g, unknown, or other
  misc_feature (404)..(404): n is a, c, t, g, unknown, or other
  misc_feature (419)..(419): n is a, c, t, g, unknown, or other
  misc_feature (468)..(468): n is a, c, t, g, unknown, or other
  misc_feature (476)..(476): n is a, c, t, g, unknown, or other
gctcttgaactagtggatcccccgggctgcaggaattcgcacgagaccattacctagaacatcctaatcgaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggaccctctggtttcctcgaattcttgttccccggtccctcctcctgtccccgcgtagatccgtccgtccgaggagcagggtgtccccacccccatgtttacccgccagttggtgtgacccccccccngctccgataaanctgaacgtgctccgnatccgccgctcccactccttctccgtcgccttcctctactggttctacntcttctcntgaacggatcgcccctctccaactgctagatgttgggcggtctcgcccgctctccttctctctgaaataggattacgaaacccatctcaagggctccatgtttctcccaatccttccccaaacccaaacgcaacatcagaaaggattccatcc

SEQ ID NO: 38431 - DNA, 658 bp, Zea mays
  misc_feature: Ceres CLONE 1426605-F
  misc_feature: Encodes the peptide sequence at SEQ ID NO. 38432
aaagctggagctccccgcggtggcggccgctctagaactagtggatcccccgggctgcaggaattcgcacgagaccattacctagaacatcctaatcgaaaaatcgaaacaaaccctccgtctccaaaagagaggccgatcctaaattcccaatccctcaaaggaaggaggattcttcatcgtctcgcttgccggccccgaatcgcagtcgccgcccggatcctaggaaacaagtcggcgtcttgctccaccgtccgcccgccacgatgagcttcatctacgagaagaacaagactcctgctgagctgctgcgggagaataagcggatgctggacaatgtccatcccggagattaacagggagaggcagggcctgcaggcccaggagaagaagctcatcaacgagatcaagaaggtggccaagcaggctcagatgggagctgtaacaattatggcaaacgatcttatccgaacaagacaccaaggcacaaatttctatgcactcaactcccagctacaaggtgtatctctacgtattcagactctgcaatcaacacaaaccatgcttgaagccatgtcgggtgtgacaaaacccatgtggcagatgaaccgacagatgaatctgcctgccctgcaaaagatcatgaggaagtttcaga

SEQ ID NO: 38432 - protein, 107 aa, Zea mays
  misc_feature: Ceres CLONE 1426605-F
  misc_feature (2)..(107): Pfam Name: Snf7 Pfam Description: Snf7
MSIPEINRERQGLQAQEKKLINEIKKVAKQAQMGAVTIMANDLIRTRHQGTNFYALNSQLQGVSLRIQTLQSTQTMLEAMSGVTKPMWQMNRQMNLPALQKIMRKFQ

SEQ ID NO: 38433 - DNA, 672 bp, Zea mays
  misc_feature: Ceres CLONE 1426610-F
  misc_feature: Encodes the peptide sequence at SEQ ID NO. 38434
aaaagctggagctccccgcggtggcggccgctctagaactagtggatcccccgggctgcaggaattcgcacgagaccattacctagaacatcctaatcgaaaaaacattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaagggggaggacagcggcgaccgctgcccttgcgagaagcagtgcgagggccaccacgaccgggaaagcaggcagcagtgcgtccaggcttgcgagcgccggcgacagcagcgcggcggcagccgtgactccaacgtcgacgaggacgacagcgaccggcggtgccagatgaaatgccggcgccacagcgatcggcaggcgaggcagtggtgcgtgcagcgctgcgagcgtaagcaacaggaggaggacgccgccgccgacgacgacaacagcggccggtgccagaagagatgccagcaccacagcgatcggcaggcgaggcagtggtgcgtgcagcgctgcgagcgtaagcaacaggaggacgccgccgcc

SEQ ID NO: 38434 - protein, 131 aa, Zea mays
  misc_feature: Ceres CLONE 1426610-F
MRCSMRKKGEDSGDRCPCEKQCEGHHDRESRQQCVQACERRRQQRGGSRDSNVDEDDSDRRCQMKCRRHSDRQARQWCVQRCERKQQEEDAAADDDNSGRCQKRCQHHSDRQARQWCVQRCERKQQEDAAA

SEQ ID NO: 38435 - DNA, 700 bp, Zea mays
  misc_feature: Ceres CLONE 1426621-F
  misc_feature: Encodes the peptide sequence at SEQ ID NO. 38436
aaagctggagctccccgcggtggcggccgctctagaactagtggatcccccgggctgcaggaattcgcacgagaccattacctagaacatcctaatcgaaaaaatcatattcttgacaccagttgcaacctaaaaagaggcatccactagctccactacatcacttctggcgaccaagatatttgcccgcctcaggctccttgctctttctacatgggttgctaactccacatttctcccacaatgctcgcaaggtcaaatagcttcactacttcccccataccttcgatcaattaaagctccaagatgtgaaaacccagctcatcaaacattctctgcttctccgccctgtcccaccatgcaacataccttgcccaccctggttgcttcgacacccgcaagccctatctgtggtgcatcattgtgacaaactctcatgggacaagagctgctctcatgcgtgttacctcggatcaaccgagaaggtctggcagaactttctccctactctcagcaacagcgatttcttccatgcagccaactgtctacacggaactctgatgcatagttgcagcatcatctatcacaatcttgccgagctagctactgactgactcgcattaacgacaacttcattcatattagccgactgctctgcactgacccccgctagcttattggcttcgacaaatactacaac

SEQ ID NO: 38436 - protein, 43 aa, Zea mays
  misc_feature: Ceres CLONE 1426621-F
MGQELLSCVLPRINREGLAELSPYSQQQRFLPCSQLSTRNSDA

SEQ ID NO: 38437 - DNA, 648 bp, Zea mays
  misc_feature: Ceres CLONE 1426623-F
  misc_feature: Encodes the peptide sequence at SEQ ID NO. 38438
  misc_feature (548)..(548): n is a, c, t, g, unknown, or other
aaagctggagctccccgcggtggcggccgctctagaactagtggatcccccgggctgcaggaattcgcacgagaccattacctagaacatcctaatcgaaaagttatcccccacccggacaatcttccttcaggcttcagctgtccgcccgcggcccacccctccgccgtctccaccattccgccgttcccaccacgccactcgccagttcggcactccctcctgtctcccccccttgccgagacggagcggacgccccgtcgcccaccccgatggctgccactctcctccacgccgccaccgcctcgctccagagctcctcccagcccgcacgcgcgggcgccgccaccgcctatcaccccctcgcgtgcaccccatccatacgcctcgcgcgctcctcgttctcgtccaatcgccgcctcgaggtttcactccgggcggattcagccggtcactgtttcgcgaggaagggagcaccccggggccgccgcgtcgtcgccgccctaattagggagcaaactgagggttcacacgtgggcgatgacgangataacagcaacgacgagataaagcctgagtaggctcatgaaacttggaaaggtatgctggagcagatcagggctgaggccctgcggatgcaggccctgt

SEQ ID NO: 38438 - protein, 102 aa, Zea mays
  misc_feature: Ceres CLONE 1426623-F
  misc_feature (92)..(92): Xaa is any aa, unknown, or other
MAATLLHAATASLQSSSQPARAGAATAYHPLACTPSIRLARSSFSSNRRLEVSLRADSAGHCFARKGAPRGRRVVAALIREQTEGSHVGDDXDNSNDEIKPE

SEQ ID NO: 38439 - DNA, 492 bp, Zea mays
  misc_feature: Ceres CLONE 1426635-F
  misc_feature (181)..(181): n is a, c, t, g, unknown, or other
  misc_feature (182)..(182): n is a, c, t, g, unknown, or other
  misc_feature (188)..(188): n is a, c, t, g, unknown, or other
  misc_feature (189)..(189): n is a, c, t, g, unknown, or other
  misc_feature (318)..(318): n is a, c, t, g, unknown, or other
  misc_feature (380)..(380): n is a, c, t, g, unknown, or other
  misc_feature (381)..(381): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (474)..(474): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaaatcacctataatattttgagcattcagaaacacaccaagcgaagcgcactagcaacaacctaacaacaatgggctaccnnaagatnnattatccctccttgcgcttctttgcgcttttttgcgaggcggccaaacaaaatgctgtcaattattcaccaaggctcacttgggcccaaggttccccattttattccccccaagtgtttcccctccccnacccctttttctttcagggggccttttcaaaacccccccacgtttgggggcgaaacggcccnnttttttttttgtgggggtccacaaaaaaaaacttttttttgtgggggggggaagggttttttttttttaaaaaaaaaacaaaaacatnnnccnnttttttgttgtgtggtt

SEQ ID NO: 38440 - DNA, 642 bp, Zea mays
  misc_feature: Ceres CLONE 1426637-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (312)..(312): n is a, c, t, g, unknown, or other
  misc_feature (340)..(340): n is a, c, t, g, unknown, or other
  misc_feature (367)..(367): n is a, c, t, g, unknown, or other
  misc_feature (370)..(370): n is a, c, t, g, unknown, or other
nnnnnnnnnnnnnnnnnnnnnnnnnnnnnnnnnnnnnnnnnnnnnnnnggggnnnnnnnnnnnnnngggggnnnnnnnnnnnnnnnnnnnnnnnnnnnnccaaactgggactccccgcggtggcggccgctctagactagtggatcccccgggctgcaggaattcgcacgagaccattacctagaacatcctaatcgaaaataactactccgtcactttgtttgcaaagctcctcctcgatccatcgatcactgcaccggccgggcggcaccgcgctcgcaggggctagccaacgagacggcagcaatggcngaaaacgtgacgcagcggcatctacggnggcgccaacgccacctacgggcagcancancagcaaggaggaaggcggcgccccaatgggttaaccagggtgaagggcatgcctccaccaaaaaggggcccaaaggggttcccaagggcctaaaaaggggggacactttttccccccggggggggttttctcctttgtggttttttgggggggtgggggcttaaaaacccccccccctgtgggggggggtttttccccttttcccccccccccgcgggggggttcccaaaaaaaattaaaccccccccccgggtgttttccccccccccccc

SEQ ID NO: 38441 - DNA, 671 bp, Zea mays
  misc_feature: Ceres CLONE 1426640-F
  misc_feature: Encodes the peptide sequence at SEQ ID NO. 38442
caaagctggagctccccgcggtggcggccgctctagaactagtggatcccccgggctgcaggaattcgcacgagaccattacctagaacatcctaatcgaaaaatcacctcagtatttgtcagaagctcaaatactgatctcactgatccagtatggctatggcaaaggcaggcgcgccgagggtctcggcggcccagctggtgactctcgggctatcactcctctgcgctgtcgccggcccggccgccgcgcagaactgcggctgccagccaaacgtatgctgcagcaagtttggctactgcggcacgaccgacgagtactgcggcgacgggtgccagtcgggcccgtgccgctcgggcggcggcggcagcagtggcggcggtggtgcgaacgtggctagcgtcgtcaccggctccttcttcaacggcatcaagagccaggccgggagcgggtgcgagggcaagaacttctacacccggagcgcgttcctgagcgccgtcaaggcgtacccaggcttcgcccatggcgggtcgcaggtgcagggcaagcgcgagatcgccgccttcttcgcgcacgccacgcacgagaccgggcatttctgctacatcagcgagatcaacaagagcaacgcctactgcgacccgaccaagaggcagtggccgtgcgccgc

SEQ ID NO: 38442 - protein, 172 aa, Zea mays
  misc_feature: Ceres CLONE 1426640-F
  misc_feature (33)..(66): Pfam Name: Chitin_bind_1 Pfam Description: Chitin recognition protein
  misc_feature (84)..(172): Pfam Name: Glyco_hydro_19 Pfam Description: Chitinase class I
  misc_feature: SWISSPROT Homolog: EC 3.2.1.14 Chitinase
MAMAKAGAPRVSAAQLVTLGLSLLCAVAGPAAAQNCGCQPNVCCSKFGYCGTTDEYCGDGCQSGPCRSGGGGSSGGGGANVASVVTGSFFNGIKSQAGSGCEGKNFYTRSAFLSAVKAYPGFAHGGSQVQGKREIAAFFAHATHETGHFCYISEINKSNAYCDPTKRQWPCA

SEQ ID NO: 38443 - DNA, 614 bp, Zea mays
  misc_feature: Ceres CLONE 1426644-F
  misc_feature (242)..(242): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (472)..(472): n is a, c, t, g, unknown, or other
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (529)..(529): n is a, c, t, g, unknown, or other
  misc_feature (537)..(537): n is a, c, t, g, unknown, or other
  misc_feature (540)..(540): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (576)..(576): n is a, c, t, g, unknown, or other
  misc_feature (599)..(599): n is a, c, t, g, unknown, or other
caaagctggagctccaccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaangcggcggctgcggctgccagccacccgccgccgggtttcatcttaccggccccccccgggggggaattctggccccccccccccccgggtgtttccccccccccccccccccccgggggggggggggggggttcccccccccccccgcggggggggggtgtttttctttttcttcgcgcggcggggggggaggggggggttttttctccacccgccgcggcgggnnnccnnannnnnntttttgttgtgtggggtgtggtcccgccgggcctccccccccccccccncccccccncangnnncgcccccccactctcccccccccccccgtttncgcccgcccccccccccccacgnacaacacaacaaacc

SEQ ID NO: 38444 - DNA, 725 bp, Zea mays
  misc_feature: Ceres CLONE 1426652-F
  misc_feature: Encodes the peptide sequence at SEQ ID NO. 38445
aagctggagctccccgcggtggcggccgctctagaactagtggatcccccgggctgcaggaattcgcacgagaccattacctagaacatcctaatcgaaaaactcccgcaggccgcagcccagcaccggccgctctacgcctccacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatgtcgcaaaagattggaatgctgtgtttgaaaggagcatcaatacattgtttttgactgaaatggtcggtggcttgatgctaactctcaagtacttctttgatagaaatgtcacaattacctatccgtttgaaaagggtccctctgaacccccgcttcccggggggagcatggctcccaaacgttatgaaatctggggaaacaacccctgcatttctttgtaaaactatgcgaaaacttttttgccccggcccaaggcaatttacaatttgagggttaaaaaacagggtaaaataggggatccccccaaaccccccaatatattttttttttccctggaccc

SEQ ID NO: 38445 - protein, 129 aa, Zea mays
  misc_feature: Ceres CLONE 1426652-F
  misc_feature: SWISSPROT Homolog: EC 1.6.5.3 NADH dehydrogenase (ubiquinone)
MASLLARQAAQALRARQTAQLGPAASAMQGHLRTYMNAGIPKRFKEDEEKEQLAKDVAKDWNAVFERSINTLFLTEMVGGLMLTLKYFFDRNVTITYPFEKGPSEPPLPGGSMAPKRYEIWGNNPCISL

SEQ ID NO: 38446 - DNA, 696 bp, Zea mays
  misc_feature: Ceres CLONE 1426658-F
  misc_feature: Translation starting site: 490
  misc_feature: SWISSPROT Homolog: EC 4.4.1.5 Lactoylglutathione lyase
aagctggagctccccgcggtggcggccgctctagaactagtggatcccccgggctgcaggaattcgcacgagaccattacctagaacatcctaatcgaaaaatcggacgaccgacgtgacaaaaccagacagtgacaacacaaaaaaaaaatggatataatcatgtcatggatcaggcatgtgcctgccagtgctgcttctcccaatggagtcggatcctgtcagaatcccaacatatgcagggcaaccgacaataaatactgcaaggccgctcacgatgtggttgactggcttaccccggacaaccccaggaagcgaccatgcgcattaccgcgatgacgtatctctaccgcaccctcaacaactacaaggaatgcttgccgatgaaactgctcatcaacaaggatgttcctgatgaaaactacacctctgtcttccttgcctttggggcaaagaacaccacttttgcacctgacttgacatacaactatggtgcttgacacgtatgacattggaccgggctttggctacttctcaatcgctatggatgatgtctcccacttaacttacaatatcttctacggcgacgataacatcacccgcgaacatgaccctgccaacgtaggatcctctgatattgccttcgcacaggatcctaatggctacatcttgcagcttatccacaaggctgactcc

SEQ ID NO: 38447 - DNA, 756 bp, Zea mays
  misc_feature: Ceres CLONE 1426659-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (279)..(279): n is a, c, t, g, unknown, or other
  misc_feature (315)..(315): n is a, c, t, g, unknown, or other
  misc_feature (606)..(606): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactggggactccaccgncggtgggcggccgctctagaactagtggaatccccncgggctgcaggaattcgcacgagaccattacctagaacatcctaatcgaaaaaaccgcagcagggcgttgggcgagtgagtgagtcagtgaggctgggatagcagcagcagcatcagtgcgccgcactcaacttctcttcttgccgtgcgggtgcggcgccggcgcgggggaggcaccggcacgggcccgcaagcaatgccgccgcccggcagaaggaacgcgccaccagccggaggaagctccaagggcgggaggactttccttccaaactccggtggttcaaactttcngccgggcaaagaaaagaggaatggggggaaaaaaaagaaaaaaacccgggagggggccggcggcgggggaaaaggccccaacccggggggggggggaaaatttttaaaagtccccaaaaaaaccccttggaaaggcccccaaacccgaaa

SEQ ID NO: 38448 - DNA, 670 bp, Zea mays
  misc_feature: Ceres CLONE 1426666-F
  misc_feature: Encodes the peptide sequence at SEQ ID NO. 38449
aagctggagctccccgcggtggcggccgctctagaactagtggatcccccgggctgcaggaattcgcacgagaccattacctagaacatcctaatcgaaaaactaaaaacatgggactccaccctgtctccgaggccaacgcttcaagccccttcggctctctctccgccgccgaattctactccctccattccgtcgcccactcctccgcctacatcaccaacccaaccggtctcaaactcttcacccaatggtggacccctctccaccgtccaccactcggcctcatcgccgtcgtccacggcttcaccggcgagtccagctggttcctccaactaacctccgtcctcttcgccaagtcagggttcctcacttgcgccatcgaccaccaaggccacggcttctccgacgggctaaccgctcacatccccaacatcaacctcatcgtcgacgactgcatctccttcttcgacgacttccgtagccgtcacgcttcctcctcctccctaccttccttcctctactccgagtccctcggcggcgcgatagctctctacatcaccctccgcagaaatcaaaatggaacgtctcatcctcagcggcgccatgtgctccatcagccacaagttcaaacccccgtggcccgtaacacaccctcttacccctcgcg

SEQ ID NO: 38449 - protein, 186 aa, Zea mays
  misc_feature: Ceres CLONE 1426666-F
MGLHPVSEANASSPFGSLSAAEFYSLHSVAHSSAYITNPTGLKLFTQWWTPLHRPPLGLIAVVHGFTGESSWFLQLTSVLFAKSGFLTCAIDHQGHGFSDGLTAHIPNINLIVDDCISFFDDFRSRHASSSSLPSFLYSESLGGAIALYITLRRNQNGTSHPQRRHVLHQPQVQTPVARNTPSYPS

SEQ ID NO: 38450 - DNA, 707 bp, Zea mays
  misc_feature: Ceres CLONE 1426669-F
  misc_feature: Encodes the peptide sequence at SEQ ID NO. 38451
  misc_feature (410)..(410): n is a, c, t, g, unknown, or other
  misc_feature (482)..(482): n is a, c, t, g, unknown, or other
  misc_feature (624)..(624): n is a, c, t, g, unknown, or other
  misc_feature (675)..(675): n is a, c, t, g, unknown, or other
tggagctccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccangagattgcgtgcgcgcaggacgcgctgagacacaaggcatcatcctatcccacggtgaccgtggaagccctnagagtgcaggggtcgtcgttcctggtgaacgtgttctcccgacagagctgcccggggctgctcgtcgccgtgctggaagccttcaacgactggggctcagcgtgctccaggcaccgcgtcctgcgccgactccttccgctcnaggcgtgggcggaaagacgtggcgaacacgtggacaaccactcgtgagcangcgtcctgcagccgtcaggactgctccaggcg

SEQ ID NO: 38451 - protein, 139 aa, Zea mays
  misc_feature: Ceres CLONE 1426669-F
  misc_feature (53)..(53): Xaa is any aa, unknown, or other
  misc_feature (125)..(125): Xaa is any aa, unknown, or other
MMSRERKKAAALQEKLKILRSITHSHALSNTSIIMDASAYIKELKQKVVRLNXEIACAQDALRHKASSYPTVTVEALRVQGSSFLVNVFSRQSCPGLLVAVLEAFNDWGSACSRHRVLRRLLPLXAWAERRGEHVDNHS

SEQ ID NO: 38452 - DNA, 652 bp, Zea mays
  misc_feature: Ceres CLONE 1426680-F
  misc_feature: Encodes the peptide sequence at SEQ ID NO. 38453
aagctggagctccccgcggtggcggccgctctagaactagtggatcccccgggctgcaggaattcgcacgagaccattacctagaacatcctaatcgaaaagtattagaaaaagatttgaacatgagtgagcatcatcattttgcgtttgtgcacggtgcagggcatggaggatggtgttggtacaagctcgccaattcactgagagagaatggacataaggccacctgcatcgacctcaagggcgctgggatcaacctaactgatccaaacactgtctcctctcttgatgactacaaccagcctctctatgacttcctctcccaacttcccctcgaccaaaaggtcattctggtgagccacagcgttggaggagggagcatgacggctgccatgtgccagtatccttccaaagtctccatggctgtttacgtcgcagcagccatggtcaaacctggtaccataattcccccaattctcaaggaagtactaaagatatgttcagggatgatagagacggaagctgagaagatatgggacttcacttttggaaatggacccgagaatctccccacaagtatgatgatgaaacctgagtatgtccgggacaagtattacaacgagagccccatggaggttaattatcttttatt

SEQ ID NO: 38453 - protein, 176 aa, Zea mays
  misc_feature: Ceres CLONE 1426680-F
  misc_feature: SWISSPROT Homolog: EC 3.1.1.78 Polyneuridine-aldehyde esterase
MSEHHHFAFVHGAGHGGWCWYKLANSLRENGHKATCIDLKGAGINLTDPNTVSSLDDYNQPLYDFLSQLPLDQKVILVSHSVGGGSMTAAMCQYPSKVSMAVYVAAAMVKPGTIIPPILKEVLKICSGMIETEAEKIWDFTFGNGPENLPTSMMMKPEYVRDKYYNESPMEVNYLL

SEQ ID NO: 38454 - DNA, 664 bp, Zea mays
  misc_feature: Ceres CLONE 1426713-F
  misc_feature: Translation starting site: 166
ggagctccccgcggtggcggccgctctagaactagtggatcccccgggctgcaggaattcgcacgagaccattacctagaacatcctaatcgaaaacacacccgcatctgcttcattccacccgccccgcgaggagcttctagaaggggagaccccggcggagccatggcggaggaaaaggagtcgacgtcgatcccgctcagccaggcggcggaggctgtcgaccccgaggacccggccaagtcgccgccgcgacccagctcgcccaccacctccacacgcaagtcccctatatgcaaaaattggaatcgacatatttggtcttggttttttgacttctctggtattcatatttctggttggaatatttgtttcttcatgggttggttcaaccatcttctgggtgggcgagtggtttataaagaaatccatttgtaagacatatatattcagcatcaaagcaagtcagcactgcaatttcaccagatcaaaatacgactgctttcaaagaagttgcaataattcgtcatccacgaattggtgaatatgcatttggattcataacatcaacggtggtccttcagactgacaaaggcgatgaagaactgtgtagtgtgtatgtgccaacaaatcatctatacatcggtgacatatttctggtgaa

SEQ ID NO: 38455 - DNA, 667 bp, Zea mays
  misc_feature: Ceres CLONE 1426717-F
  misc_feature: Encodes the peptide sequence at SEQ ID NO. 38456
  misc_feature (380)..(380): n is a, c, t, g, unknown, or other
  misc_feature (386)..(386): n is a, c, t, g, unknown, or other
ctggagctccccgcggtggcggccgctctagaactagtggatcccccgggctgcaggaattcgcacgagaccattacctagaacatcctaatcgaaaaactgcaaccccggaacagagcgaggcgacgccgaggcacctcatctccggcgaagggaaatggcgaccgttccaggggatctgatctggcagattgtgaggaagaacaactccttcctggtgaagcagtttggcaacggcaatgccaaggtgcagttcaccaaggagcccaacaacctctacaatttacactcctacaagtactctggcttagcaaacaagaaaactgtaacgatccagccagctgctggaaaagactcggctgtggtcctctctactaccnagaccnagaagcagaacacacccgcgaagctcagcccacagtctgtgatgcgcaaggagttccgcagatgggccaagctgtgaaaaacaagttggcgaccactaatacaggcctgatttgacaaatcggcccttgggaggctgaccctcctggtacgcaacctccaggttgcaaattctggggccaaaaaaaaaaagggcccctacccttaacccggtttttttcccttggggccccaagcccccccttatttttcccaatgtcccccaaattttttgaaaatttgt

SEQ ID NO: 38456 - protein, 101 aa, Zea mays
  misc_feature: Ceres CLONE 1426717-F
  misc_feature (5)..(100): Pfam Name: Ribosomal_L28e Pfam Description: Ribosomal L28e protein family
  misc_feature (75)..(75): Xaa is any aa, unknown, or other
  misc_feature (77)..(77): Xaa is any aa, unknown, or other
MATVPGDLIWQIVRKNNSFLVKQFGNGNAKVQFTKEPNNLYNLHSYKYSGLANKKTVTIQPAAGKDSAVVLSTTXTXKQNTPAKLSPQSVMRKEFRRWAKL

SEQ ID NO: 38457 - DNA, 387 bp, Zea mays
  misc_feature: Ceres CLONE 1426718-F
  misc_feature (184)..(184): n is a, c, t, g, unknown, or other
tggactccccgcggtggcggccgctctagaactagtggacccccgggctgcggattcgcacgagaccattacctagaacatcctaatcgaaaaaaggtcagccagccaaacgccaccgccgccgtgctcgcgccgcacgcaactctcagctctctgacgcctcctcctccgtcgattcccgacnagagaagacccccaaacccaccaaggttaggaaaggacccccaaaaatgggaaccggggaaccaggaaattcccccttcaaaacaaaaaaaaaaaggccccagggggggggggggcgccccaaaaggaaaaattttcttttaaaacacctttttggaggggaaaaaaaaaaaaaacccgggggggtggcccccccccctttaa

SEQ ID NO: 38458 - DNA, 662 bp, Zea mays
  misc_feature: Ceres CLONE 1426723-F
  misc_feature: Encodes the peptide sequence at SEQ ID NO. 38459
tggagctccccgcggtggcggccgctctagaactagtggatcccccgggctgcaggaattcgcacgagaccattacctagaacatcctaatcgaaaatttttcgacaacgccaaacatctggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaggattgcgtgatgcaattgctgctgggatcacctcacgtgacggattccctgcaaatgcagatgacattt

SEQ ID NO: 38459 - protein, 142 aa, Zea mays
  misc_feature: Ceres CLONE 1426723-F
  misc_feature: SWISSPROT Homolog: EC 2.6.1.2 Alanine transaminase
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRDGFPANADDI

SEQ ID NO: 38460 - DNA, 626 bp, Zea mays
  misc_feature: Ceres CLONE 1426724-F
  misc_feature (213)..(213): n is a, c, t, g, unknown, or other
  misc_feature (214)..(214): n is a, c, t, g, unknown, or other
  misc_feature (342)..(342): n is a, c, t, g, unknown, or other
  misc_feature (352)..(352): n is a, c, t, g, unknown, or other
  misc_feature (406)..(406): n is a, c, t, g, unknown, or other
  misc_feature (461)..(461): n is a, c, t, g, unknown, or other
  misc_feature (505)..(505): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaaattggggcaggatcccgcgatggctcccagctcggtggcgtggaacccgtccgtggcgcccgcgaggccgaggtcgagctcggtgagcgccgcggctgctgccgggtgcgnnctgcgagcgcccggcccgatgtcctccgtccagcagtagaactcggagaggtcgagcgccctgagcgctgggcagtccccgaggagcggctcgagatccgcgccggcgtcgaggcccggcgggcgctnggtgccagcngcacgaaagcttgacgctgcggaggcgggacctccagtgcgggggaggctgacnagcgtggtggggtcgcggcagtagacggcgagcgaggacacgcggggagcagtangcgaggcgcgcgcgaccagctcgttctgctccgcgacctgctgncgcgtcacggacgggcgcgacggcgtccgccgacgggcccccccggaggaaaaagaaaacgggtggccccccccggggaaccccancccaaaaagtcccagccccttcccaccgcccggga

SEQ ID NO: 38461 - DNA, 677 bp, Zea mays
  misc_feature: Ceres CLONE 1426747-F
  misc_feature: Encodes the peptide sequence at SEQ ID NO. 38462
  misc_feature (48)..(48): n is a, c, t, g, unknown, or other
  misc_feature (396)..(396): n is a, c, t, g, unknown, or other
  misc_feature (398)..(398): n is a, c, t, g, unknown, or other
  misc_feature (405)..(405): n is a, c, t, g, unknown, or other
  misc_feature (407)..(407): n is a, c, t, g, unknown, or other
  misc_feature (408)..(408): n is a, c, t, g, unknown, or other
  misc_feature (556)..(556): n is a, c, t, g, unknown, or other
  misc_feature (645)..(645): n is a, c, t, g, unknown, or other
  misc_feature (648)..(648): n is a, c, t, g, unknown, or other
  misc_feature (661)..(661): n is a, c, t, g, unknown, or other
aacgactggagctcaccgcggtggcggccgctctagaactagtggatnccccgggctgcaggaattcgcacgagaccattacctagaacatcctaatcgaaaaagcggatcttctcgagcggcggccggcgatggcagcgagcaacatcgggatgatggacggagcctacttcgtcgggcgcaacgagatcctcgcgtggatcaacactacgctgcagctcggcctctccaaggtggaggaggcggcgtcaggcgcggttgcctgccaactgatggacgcggcgcatcccggcgccgtgccgatgcacaaggtcaacttctacgccaagacggagtacgacatgatccaaaactacaaggtcctccccccccctctggagggaagcagggggactnancttatananntaaacccccttttcaaagaaggccccttgaccatctggagttctggcggggataaaacaattttgtgatccttccatgggggtttcatgagcactaccaatgcttccgaaaaaaaggaaagcccccacaggggaaaggaaacaaacgnaagggcattcgttccccctccacccccgggccaatgttgctcccacaggccaaaggggtcaagcctcacgtggggccaaagcgggaaancgnggaaaaccccctnttttcccactagggcg

SEQ ID NO: 38462 - protein, 114 aa, Zea mays
  misc_feature: Ceres CLONE 1426747-F
  misc_feature (89)..(89): Xaa is any aa, unknown, or other
  misc_feature (92)..(92): Xaa is any aa, unknown, or other
  misc_feature (93)..(93): Xaa is any aa, unknown, or other
MAASNIGMMDGAYFVGRNEILAWINTTLQLGLSKVEEAASGAVACQLMDAAHPGAVPMHKVNFYAKTEYDMIQNYKVLPPPLEGSRGTXLIXXNPLFKEGPLTIWSSGGDKTIL

SEQ ID NO: 38463 - DNA, 652 bp, Zea mays
  misc_feature: Ceres CLONE 1426759-F
  misc_feature: Translation starting site: 276
  misc_feature: Pfam Name: CK_II_beta Pfam Description: Casein kinase II regulatory subunit
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaaagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaagggctgggctggactcgaagcggatcaacgacgcgctggataagcatctcgaagaggcggtcgcgtcgccgtccacctcgagggggtcagcaggcggnaggtccaaccaccaccgcctcgtcgtggcgacctccgtgacgtccatcccccagggccgctgcgtcgaaagggaatctgattctgataatgaaacatccgatggtagcggctctgaatgaaaagaccctcatggatttcatggtaatgcaacttaagaaggaatgaattcctccgtgaagtccacgatgattatattcaagaagacttcaaacttttgtggtctcaacaaccaagtttcttattaatgata

SEQ ID NO: 38464 - DNA, 779 bp, Zea mays
  misc_feature: Ceres CLONE 1426789-F
  misc_feature: Translation starting site: 684
  misc_feature (13)..(13): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (55)..(55): n is a, c, t, g, unknown, or other
  misc_feature (56)..(56): n is a, c, t, g, unknown, or other
ttgggggtggggnttgtttctccccccccnnnnaggnnnnngggggcactcagannaggaaactggggctccccgcggtggcggccgctctacaatagtggatcccccgggagtgcaggaattcgcacgagaccattacctagaacatcctaatcgaaaaaaggaaacagtcacgtctcccagatctaactccccccgactcacgaatcccagagagcctccgtggcgacgcaccgccactggctcccactcctcctcgtggccgccgccctcgccctcgccgccgtccctgctcgcgcggcgctgggcggcgggcgcggcccgctgctggggaggtggaacccgatccctgacgtgagcgactcgcacatccaggagctaggcgggtgggcgctggggcaggcgaagcaccagaagctggccgccgacgggctggtgttcccccgcgtggtgcgcggcgagcaggaggtcttgttcccccataaactagggcctctacggtcaaccccagcgaacccggggggggcgcaccggtgggccagacgtcgcccgtcgcggaacgaggcgaggtctggggacccgggccccgcccagcgtcgcttccctgcaacgcggggggcgccggggggcccgttggaaaccatagcggacacgggggggggccggaaagcgaaccggggaagatggttcctcggggccggtgtgcgtggggggaggctaaagcgttattaattgcgtgtcgtattgaaggggaaaggaaagggtgtcccccctgggtg

SEQ ID NO: 38465 - DNA, 720 bp, Zea mays
  misc_feature: Ceres CLONE 1426814-F
  misc_feature: Encodes the peptide sequence at SEQ ID NO. 38466
  misc_feature (364)..(364): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
caagctggagctccccgcggtggcggccgctctagaactagtggatcccccgggctgcaggaattcgcacgagaccattacctagaacatcctaatcgaaaaagcggccactacacttccacatagagggaaggggaggttggccagagagcctagagcagccctgcagtcgagagcatccgaactgctagctactagcaatagcataagcagataagctcgggccgggccggggcacgcgcacaatgaggtcgcggcggtggcacttcgtggtcgccgtagcgttggcagccgcggcgtgctggtggtgcgcggtggagcaggcgcaggcgcacgcgaagattgagcagagctactacgtgtngtgatgagatgacgaggagacgctggtccgcggtgccgttctcgtgggcccccccgaaaccttcaacgcggcgccggggggggctcggggggttcttccaagagtgcttcgnnngggggtggaaactccccgtggctgctgtcggccccccacgacgaaatacatcgcggggccaccgacccccacccttgtcccccggaaccccctccgtacctgttccaccctgtcccaaaggtccgccctaggaaacccgaaccccccggagttgggcccacacctgggtagtgccaagggccaccacatttttttgtgccttttgggcctgcccgggcgaaaagttcctcttatcccaataa

SEQ ID NO: 38466 - protein, 39 aa, Zea mays
  misc_feature: Ceres CLONE 1426814-F
MRSRRWHFVVAVALAAAACWWCAVEQAQAHAKIEQSYYV

SEQ ID NO: 38467 - DNA, 655 bp, Zea mays
  misc_feature: Ceres CLONE 1426838-F
  misc_feature: Encodes the peptide sequence at SEQ ID NO. 38468
ggagctccccgcggtggcggccgctctagaactagtggatcccccgggctgcaggaattcgcacgagaccattacctagaacatcctaatcgaaattttcgttcccctttccgccgtgcctcccactaaaccctagatctctctctctagaatgccgacgccttcggctctcagcaagcgcggcggcgacggcggggacggcatcctggccgccctctcccgttcgcaggtggcggcgcacgggcgagaggcggcggccgtggcgaagaagctgctgcggagcacggggaaggcggcgtggatcgcggggacaaccttcctggtgctggtggtgccgctgatcatcgagatggaccgggagcagcagctcaacgacctcgagctgcagcagcagacgcttctgggcggggccccccgccgcgcccgcgaaccaagtagatagatccggtgcatcgacccctttggtcccccccccccttttcccttttctagaaggaatcctgttactaaccaagtccatcctttcggaggtaccttatcaaggtcctcccttccggggttttcctttcaaagggttcccccttttcccaactcccaatttttgggggcccaaaggggggggttttttctcccggggcgcacacccgttttttgt

SEQ ID NO: 38468 - protein, 96 aa, Zea mays
  misc_feature: Ceres CLONE 1426838-F
MPTPSALSKRGGDGGDGILAALSRSQVAAHGREAAAVAKKLLRSTGKAAWIAGTTFLVLVVPLIIEMDREQQLNDLELQQQTLLGGAPRRAREPSR

SEQ ID NO: 38469 - DNA, 666 bp, Zea mays
  misc_feature: Ceres CLONE 1426842-F
  misc_feature: Encodes the peptide sequence at SEQ ID NO. 38470
ctggagctccccgcggtggcggccgctctagaactagtggatcccccgggctgcaggaattcgcacgagaccattacctagaacatcctaatcgaaaaaccaaacaaaccgcgtccgcgtcgagtctctagtctctactctctcggctgtcctgtccggcgcggctctcgcgtctccaacctacccatgctgcagctcctccaactccaaggctcacaccaccccgcgacgggcgacgctaattaagtagagctgcaacacctgggttggaggctagagcttgcaaacaccaccagcgaaaacgtcgtggccagccatcccggtgtcgtcccgcgttctacagcctctgcatcccgcgttctacagccaccgctgttgtcgccgtcctagactcctagatccgtcagcttaacgagctccattccttcgcggccagccatcccggtgtctcagcggcggcggcggcggcgtcgagctcttgctttctgtgggaggacgcatggcgatgtctgcggggcgtgggctcttggtcctcttcttctctgccgccgtagtggctgagctcgcctctgccgcgaacggtcctttcctgtccgatagcgtcttccagtcgagcgccggatctacagggaggagcttgctgcaggccaagaatagttgccctgt

SEQ ID NO: 38470 - protein, 55 aa, Zea mays
  misc_feature: Ceres CLONE 1426842-F
MAMSAGRGLLVLFFSAAVVAELASAANGPFLSDSVFQSSAGSTGRSLLQAKNSCP

SEQ ID NO: 38471 - DNA, 770 bp, Zea mays
  misc_feature: Ceres CLONE 1426847-F
  misc_feature: Translation starting site: 164
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (43)..(43): n is a, c, t, g, unknown, or other
  misc_feature (52)..(52): n is a, c, t, g, unknown, or other
  misc_feature (54)..(54): n is a, c, t, g, unknown, or other
  misc_feature (298)..(298): n is a, c, t, g, unknown, or other
  misc_feature (343)..(343): n is a, c, t, g, unknown, or other
  misc_feature (355)..(355): n is a, c, t, g, unknown, or other
  misc_feature (362)..(362): n is a, c, t, g, unknown, or other
  misc_feature (364)..(364): n is a, c, t, g, unknown, or other
  misc_feature (369)..(369): n is a, c, t, g, unknown, or other
  misc_feature (381)..(381): n is a, c, t, g, unknown, or other
  misc_feature (389)..(389): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (403)..(403): n is a, c, t, g, unknown, or other
  misc_feature (404)..(404): n is a, c, t, g, unknown, or other
  misc_feature (417)..(417): n is a, c, t, g, unknown, or other
  misc_feature (435)..(435): n is a, c, t, g, unknown, or other
  misc_feature (436)..(436): n is a, c, t, g, unknown, or other
  misc_feature (440)..(440): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (448)..(448): n is a, c, t, g, unknown, or other
  misc_feature (451)..(451): n is a, c, t, g, unknown, or other
  misc_feature (452)..(452): n is a, c, t, g, unknown, or other
  misc_feature (471)..(471): n is a, c, t, g, unknown, or other
  misc_feature (473)..(473): n is a, c, t, g, unknown, or other
  misc_feature (474)..(474): n is a, c, t, g, unknown, or other
  misc_feature (476)..(476): n is a, c, t, g, unknown, or other
  misc_feature (478)..(478): n is a, c, t, g, unknown, or other
  misc_feature (480)..(480): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (495)..(495): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (513)..(513): n is a, c, t, g, unknown, or other
  misc_feature (514)..(514): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (575)..(575): n is a, c, t, g, unknown, or other
  misc_feature (719)..(719): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
tggttttggggnncnncnnnnncggcgacgcggggtttctccnttccgcgcngngtcaaactggtactcctccgtggtggcggccgctctagaactagtggatcccccgggctgcaggaattcgcacgagaccattacctagaacatcctaatcgaaaaaaccatgtccgactacaaccgctacggccacagctacagctacggcggcgggtacggccaagggccagcgccctcgggcccgccggcaccgcacatgcccaccgctacatccggcgccccgccctcctcctcctcatanggggcgtacgccgggtacccgcccgcctaccctccgccgccctcncaggcggcgggnggattcngncccgntgggtccgggtncgggttcntcccngnngggttnncgccggggacgcngggggacgtggggggtgnnttgngggnnngngannggggcgggggggggggggncnncnancncnnnntnnnngnagngcnnnnnnnnggnnnccnncnnnnnnannnnccgcaccnnntcgccttccctcaccgttcctcttccaatggaccgtttnttttctcaactccggtcacgggatagaaggtcacaccacacgcactacttcgcttggttagtgaccaacacccccatgttcgggggcacaatttttgaaaagggagcgtccactgttattaagacggctgtcactcatcccccncacttnnnnnnnnngcaagnnnnnnnnnnnnnnnnccgcgcatctggagcg

SEQ ID NO: 38472 - DNA, 694 bp, Zea mays
  misc_feature: Ceres CLONE 1426849-F
  misc_feature: Encodes the peptide sequence at SEQ ID NO. 38473
  misc_feature (377)..(377): n is a, c, t, g, unknown, or other
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaangggcctagcaccgaggagatcgacgaagccttccgaagggntcctgatcctcacccagcactacggctaccactttctcgcagcagcaggtccacaggaagaaatcaatcgtccggggtgcaagcttaagccccagcacaacctgggcaccaagaaaaaggtgggccttgttgtcctttccaaggcaacccaggttttgcctgggccccaaatttcctgggttcaggggtccttggctgggtttgtgggcccccccctcgttgtttataaaaaaaaggttctcccccccggggggaaatttgggccccccatggggg

SEQ ID NO: 38473 - protein, 111 aa, Zea mays
  misc_feature: Ceres CLONE 1426849-F
  misc_feature (37)..(95): Pfam Name: Pex14_N Pfam Description: Peroxisomal membrane anchor protein (Pex14p) conserved region
  misc_feature (69)..(69): Xaa is any aa, unknown, or other
  misc_feature (83)..(83): Xaa is any aa, unknown, or other
MASGIGSGQQQPPAPAADADPGAVGDKLVFEAPPQPVREDYVQNAVKFLSHPKVRGSPVVYRRSFLEKXGPSTEEIDEAFRRXPDPHPALRLPLSRSSRSTGRNQSSGVQA

SEQ ID NO: 38474 - DNA, 666 bp, Zea mays
  misc_feature: Ceres CLONE 1426852-F
aaagctggagctccccgcggtggcggccgctctataatagtggatcccccgggctgcaggaattcgcacgagaccattacctagaacatcctaatcgaaaaacagttttccctcggttgctgagagaaaggtgcccttgctgtcaccgagagtaacaaatatcagaccaactgctccttctcgcagtgaagcttgagcttgcattaatctaccatatgtttgatggagatgctccacaccgtcgaggcgtagaaatacagagaggaggaggtagcgcccgcggcgacaaccacgagcaggaacgcctcagccactggatgcgactagggagcgcacgtgccccaggggtgggccaagaagaagcgctcacgccgacgggtgtcagaggaggagaatcttggggtctgtctgatcatgctctcccgcggtggccaacaccgagtccaggcgccgacaacgcaggtcccatccgcggcgccggccgtacgcggagtgaatggtgattcgtatgcgggaagtccttcatctcctatcaggaggtggggggccacaagatcaaccactgggtcatagtgccaactgctcctactcctcctattgccgacaatttaactgtctcggcagaaatgacatggcccggaggtccccaccccgtatcaccgtagt

SEQ ID NO: 38475 - DNA, 670 bp, Zea mays
  misc_feature: Ceres CLONE 1426859-F
  misc_feature: Encodes the peptide sequence at SEQ ID NO. 38476
aaagctggagctccccgcggtggcggccgctctagaactagtggatcccccgggctgcaggaattcgcacgagaccattacctagaacatcctaatcgaaaaaatgccactgtgagtctgtgaccacaccaaacgccggcggagtcgtcagtcgtgcgtgcccgtcccgttctgcccccacctcccctcccccgactccctcactcttcctcttccgttccatttcaagatccctgcagccgtccgtccatccatccatccatccatccgttaagaggagaggggaagccggccggccggccggccggtggagcggagatgagggggcagacagagacaggccggtggcgaggaggcgacggcgctgcggcgtggtgggtggccgtggtggccctgcagctgggccattcactgagccgcgcgcgggcggggctgctggagtccaacccgggcctggcctacaacttctaccagagcagctgccccagcgcggagtccatcgtccgcagcgtcacctgggcgcaggtcgccgccgaccccgcgctcccggcccgcctcctccgcctccacttccatgactgcttcgtcaagggctgcgacgcgtcgatcctgctggacaacgcgcagagcgagaagacggcggcgccgaacctgtcggtgggcgggtaca

SEQ ID NO: 38476 - protein, 117 aa, Zea mays
  misc_feature: Ceres CLONE 1426859-F
  misc_feature: SWISSPROT Homolog: EC 1.11.1.7 Peroxidase
MRGQTETGRWRGGDGAAAWWVAVVALQLGHSLSRARAGLLESNPGLAYNFYQSSCPSAESIVRSVTWAQVAADPALPARLLRLHFHDCFVKGCDASILLDNAQSEKTAAPNLSVGGY

SEQ ID NO: 38477 - DNA, 624 bp, Zea mays
  misc_feature: Ceres CLONE 1426871-F
  misc_feature: SWISSPROT Homolog: EC 2.7.10.2 Non-specific protein-tyrosine kinase
  misc_feature (229)..(229): n is a, c, t, g, unknown, or other
  misc_feature (288)..(288): n is a, c, t, g, unknown, or other
  misc_feature (290)..(290): n is a, c, t, g, unknown, or other
ctggagctccccgcggtggcggccgctctagaactagtggatcccccgggctgcaggaattcgcacgagaccattacctagaacatcctaatcgaaaaatccttcctggtgctctgtccacctctctcgctctgggccgccgccgccgccctaagccacgtgctgaggctttcgttggtctctttcgcggcgacgagcacccagttctgtagaaatggctgaatgtgangacatccagcctcttgtctgcgaccatggcactggaatggtcaagggctgttttgctgncnaatgagcaccccaaggcgggtttcccctaaccatggttggccgtcctcgccccactggggttcagggtatgggattgggaaaaagggacccattgttgggccataaagcccaatcccaaaaaagggttccttaacctcaaaatccccaatttagaaccggatttttgagccccctgggataacactgggaaaaaaattggggtctaatttttttacaaaaaatttcttgttttcccccaaaaaaaacccctggttggtctcaccaaaggtccttttgttacccccagggcccccgggggaaaaaataccccccttttttttgtttaaaaacttt

SEQ ID NO: 38478 - DNA, 663 bp, Zea mays
  misc_feature: Ceres CLONE 1426872-F
  misc_feature: Encodes the peptide sequence at SEQ ID NO. 38479
aagctggagctccccgcggtggcggccgctctagaactagtggatcccccgggctgcaggaattcgcacgagaccattacctagaacatcctaatcgaaaaaaacaaatacatatattgtcggcattagctcttaccctttcacccatgatgacgaagtgccagaagcgcgcgagcatccaagaactgtggctcctttccatggttcttctagcgtcgtcctctcttgtctgtgcatgcatggcggtagatgggcaaaccaaagaggacatgaacgcaacgaatgtgacgagcatgaacatgacgaggtcgtcgtcagcgagctacaacatgactggcggcggcggagaacttaacagaggtccgtgcgtcgtgagatctggattctactggtgccagaacattggctatccgaccatgtcggagtgcttgaagaactgcgaatcgtaaagcactggagtatagaaaaggaataaagtggtctctgctagcttaatttctccagtccatacaattgattaactgtgttccacacttcgtcctagagaccgcacatattcccaacagtaaacgtgcacaattctgacgacgtctctaacccgtaatgtgcacaaatctgatcatcagtaccgaaaacgctgctttgagtgtctgaagcactcga

SEQ ID NO: 38479 - protein, 99 aa, Zea mays
  misc_feature: Ceres CLONE 1426872-F
  misc_feature (18)..(97): Pfam Name: BAP Pfam Description: Basal layer antifungal peptide (BAP)
MTKCQKRASIQELWLLSMVLLASSSLVCACMAVDGQTKEDMNATNVTSMNMTRSSSASYNMTGGGGELNRGPCVVRSGFYWCQNIGYPTMSECLKNCES

SEQ ID NO: 38480 - DNA, 593 bp, Zea mays
  misc_feature: Ceres CLONE 1426882-F
  misc_feature: Encodes the peptide sequence at SEQ ID NO. 38481
  misc_feature (163)..(163): n is a, c, t, g, unknown, or other
  misc_feature (229)..(229): n is a, c, t, g, unknown, or other
  misc_feature (244)..(244): n is a, c, t, g, unknown, or other
  misc_feature (253)..(253): n is a, c, t, g, unknown, or other
  misc_feature (265)..(265): n is a, c, t, g, unknown, or other
  misc_feature (266)..(266): n is a, c, t, g, unknown, or other
  misc_feature (273)..(273): n is a, c, t, g, unknown, or other
  misc_feature (281)..(281): n is a, c, t, g, unknown, or other
  misc_feature (283)..(283): n is a, c, t, g, unknown, or other
  misc_feature (284)..(284): n is a, c, t, g, unknown, or other
aaagctggagctccccgcggtggcggccgctctagaactagtggatcccccgggctgcaggaattcgcacgagaccatacctagaacatcctaatcaaaaaatcgcgaaagcgagcgcgaggcgagtcggccggcgaagggggcggatggcgcgcgggctgcncggcgtccgcgacgacctatccgagctggggcgcccactgctcgacatcgcctgctttctgcaccngctcctcaaccgggnccaaacganttccccgcaccnnaccccangggggcgncnngcgcccgggccgtttcccgtccccggaccccgcccgggcggcggtaaccgttggttccttgggggattcctttccgaccttgccaaagttgggggttcctcccggggggggttttcccggttttttgggggggcccgaaaacccccgcccccaaagggtttgatttaaaaagggggggcccttttcccccgtccccgggttccgcccttcctgtgggttttggaacaaaatttcaaaaaaaatttctgggggaaaaaggtgtgtccccctccccggggggcccgaggggggggtttttttttcctcccc

SEQ ID NO: 38481 - protein, 101 aa, Zea mays
  misc_feature: Ceres CLONE 1426882-F
  misc_feature (6)..(6): Xaa is any aa, unknown, or other
  misc_feature (28)..(28): Xaa is any aa, unknown, or other
  misc_feature (33)..(33): Xaa is any aa, unknown, or other
  misc_feature (36)..(36): Xaa is any aa, unknown, or other
  misc_feature (40)..(40): Xaa is any aa, unknown, or other
  misc_feature (43)..(43): Xaa is any aa, unknown, or other
  misc_feature (46)..(46): Xaa is any aa, unknown, or other
MARGLXGVRDDLSELGRPLLDIACFLHXLLNRXQTXSPHXTPXGRXAPGPFPVPGPRPGGGNRWFLGGFLSDLAKVGGSSRGGFSRFFGGARKPPPPKGLI

SEQ ID NO: 38482 - DNA, 581 bp, Zea mays
  misc_feature: Ceres CLONE 1426887-F
  misc_feature: Encodes the peptide sequence at SEQ ID NO. 38483
  misc_feature (367)..(367): n is a, c, t, g, unknown, or other
caaagctggagctccccgcggtggcggccgctctagaactagtggatcccccgggctgcaggaattcgcacgagaccattacctagaacatcctaatcgaaaaatactatatattagacataccggtattattgttcttagacatcgcacaagactcttgtcaacaagaccaacaacaggatgaggactgccgtgcatgctgcgctttgcattgtgcttgtgataatgtcttcaacactgtcatcttgcgaggacgatgagaaggtatctatcgcatgtgacacagggatgcatgccgcgatctcccgtctcaaatgcttcctgatgggctattctgaaggggaaaagtgtgtcaccagcaactgcnaaaacgccgaccaagtgccgctgcctggttcctcccaaacagaatgcagcctttatcgccgggaacgttgggcacaaaagggaaactgattgcgaaccgggccctccttgtttaaaaaaaccggcagaaataaaatggggccccaaccaaatcccctaaagggtattcctcccgggaaagcttcccccccggtcccgaattaggttaaacaaaa

SEQ ID NO: 38483 - protein, 91 aa, Zea mays
  misc_feature: Ceres CLONE 1426887-F
  misc_feature (63)..(63): Xaa is any aa, unknown, or other
MRTAVHAALCIVLVIMSSTLSSCEDDEKVSIACDTGMHAAISRLKCFLMGYSEGEKCVTSNCXNADQVPLPGSSQTECSLYRRERWAQKGN

SEQ ID NO: 38484 - DNA, 664 bp, Zea mays
  misc_feature: Ceres CLONE 1426890-F
  misc_feature: Encodes the peptide sequence at SEQ ID NO. 38485
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (317)..(317): n is a, c, t, g, unknown, or other
  misc_feature (318)..(318): n is a, c, t, g, unknown, or other
  misc_feature (350)..(350): n is a, c, t, g, unknown, or other
  misc_feature (368)..(368): n is a, c, t, g, unknown, or other
  misc_feature (445)..(445): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatcccccgggctgcaggaattcgcacgagaccattacctagaacatcctaatcgaaaaacatacctccgaggctccgaccaaaacaccagggtcccagtgctcttggctctaagatggcggcgccggaaccggaggccaagctggaagccgtaaccccatctnncgtccacgagctgccaccggagtccgaatccngacgccctgcccctcacnggcagcagaagctaaagccgtgggagcagcacgccgcggtgatcaaactcccgcgctacgactaccgggcatcaggntccctcctccttcgttccgaattcgggctcctcatacagtgccccatcaagcgtgaaaaaggtgcacccaggaaaccctttccctcccttgaaaaataacatgcaaattggcgtggtttttgaaacatgcaaaaccctgggtgtgtggaaaaatgccctttaaaaaaaaaaaaattgggcctccgaggccccccggaaatttttaaaaaagggccctta

SEQ ID NO: 38485 - protein, 91 aa, Zea mays
  misc_feature: Ceres CLONE 1426890-F
  misc_feature (17)..(17): Xaa is any aa, unknown, or other
  misc_feature (28)..(28): Xaa is any aa, unknown, or other
  misc_feature (34)..(34): Xaa is any aa, unknown, or other
MAAPEPEAKLEAVTPSXVHELPPESESXRPAPHXQQKLKPWEQHAAVIKLPRYDYRASGSLLLRSEFGLLIQCPIKREKGAPRKPFPSLEK

SEQ ID NO: 38486 - DNA, 666 bp, Zea mays
  misc_feature: Ceres CLONE 1426895-F
  misc_feature (666)..(666): n is a, c, t, g, unknown, or other
ggagctccccgcggtggcggccgctctagaactagtggatcccccgggctgcaggaattcgcacgagaccattacctagaacatcctaatcgaaaaactttcccccggccgtcctgctcgtcgggttctggctgtgctccctgaatccgaccctggaatctattccttctgccccgccacttcactcgagtgcaggatagaatacagaacctgggttttcaccatggcatggtcctgcgtcatgggtgctctcctcctcgacatccccgccgaagcccaagagccctctccgtcgtaccacgatccccatccgtcttagcaccggtatcctcgcccacgacaaccgctcccctatgtatgaacatctggcacctcctacccatgttcagatcttgcccgagtacctccactacctgctataagacgtgcccaatcggatgcttccaaatctggcgaacaagttaatggggatcgattgcacggcattcgtgcccagagaatctgaatacaaacccttaaactgcacgagttactgctccctcccacaagaacaacactggtccttctggctctgccgctgtctgccctgttgctagtcgaaggccaatgactaccgattgatcgccctcgaactgttggacatctctagcatgttagagaacaaan

SEQ ID NO: 38487 - DNA, 579 bp, Zea mays
  misc_feature: Ceres CLONE 1426904-F
  misc_feature: Encodes the peptide sequence at SEQ ID NO. 38488
  misc_feature (298)..(298): n is a, c, t, g, unknown, or other
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaatctaaatccataatacaggagctgggagcaaagctgcagtcaagggaaaaggcagttgatgaactatcaacaaaagttaagatgctcgaggatttgtgccatgcacaactttctcagccagaacctagtaaagacagatcatttgaagcatcttcctcaacaattgggtcagatatatctgatattgaagatgcangaccagtgggcaagacaacatcagtttcatctgtttctacagctgcacatgctagaaaacatgcggaagggtcagcggatcatcttgttgtcaacattggttcagagtcagaacgattgattgctgcacagaatcagatgacnaggggcgtattaaatcgctccatacatcttgctttcattccagctcagggaaagcacatcgctgaatagggtcgatgccttccgggtctccggggagccaaattctgatgaaccggccacgagccaggctagggcttt

SEQ ID NO: 38488 - protein, 169 aa, Zea mays
  misc_feature: Ceres CLONE 1426904-F
  misc_feature (100)..(100): Xaa is any aa, unknown, or other
KAGAPRGGGRSRTSGSPGLQEFARDHYLEHPNRKSKSIIQELGAKLQSREKAVDELSTKVKMLEDLCHAQLSQPEPSKDRSFEASSSTIGSDISDIEDAXPVGKTTSVSSVSTAAHARKHAEGSADHLVVNIGSESERLIAAQNQMTRGVLNRSIHLAFIPAQGKHIAE

SEQ ID NO: 38489 - DNA, 617 bp, Zea mays
  misc_feature: Ceres CLONE 1426906-F
  misc_feature: Encodes the peptide sequence at SEQ ID NO. 38490
  misc_feature (342)..(342): n is a, c, t, g, unknown, or other
  misc_feature (557)..(557): n is a, c, t, g, unknown, or other
  misc_feature (558)..(558): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (572)..(572): n is a, c, t, g, unknown, or other
caaagctggagctccccgcggtggcggccgctctagaactagtggatcccccgggctgcaggaattcgcacgagaccattacctagaacatcctaatcgaaaaaatccggccgggccgcgcgcacgcgcaccaccggcacgcacatcaaatctcagccttcacccctctcacactgtcttcactcggttcgagcaaggggggcagcgagcgaagcggtaggtagcagcagtgtacgtgctgccgccaagctagtgccaatggcgagggcggtggcgatgctcgtggccctggcgctggtcgtggtggtggcggtggcgagcgcgggcggggcggcggcgcancagtgcagcgcggcgcatctggcggcgtgcgccccggcgatcatcagcgggtcgccgcccacggcgtcgtgctgctccaacctgcgcgggcaagagccctggctttcttcctttacccccgcaaacccggggttaaaaaaattttatttttaaaagcccccaaaaagccgcccgcgagatgtttcccctcttttgggggggggagctcccccccnncnnnnncncaccanaagggtggtggtggttttatttaaaaccccgcccccgccgcgggg

SEQ ID NO: 38490 - protein, 78 aa, Zea mays
  misc_feature: Ceres CLONE 1426906-F
  misc_feature (28)..(28): Xaa is any aa, unknown, or other
MARAVAMLVALALVVVVAVASAGGAAAXQCSAAHLAACAPAIISGSPPTASCCSNLRGQEPWLSSFTPANPGLKKFYF

SEQ ID NO: 38491 - DNA, 513 bp, Zea mays
  misc_feature: Ceres CLONE 1426912-F
  misc_feature: Encodes the peptide sequence at SEQ ID NO. 38492
  misc_feature (209)..(209): n is a, c, t, g, unknown, or other
  misc_feature (224)..(224): n is a, c, t, g, unknown, or other
  misc_feature (264)..(264): n is a, c, t, g, unknown, or other
  misc_feature (270)..(270): n is a, c, t, g, unknown, or other
aaaagctggagctcaccgcggtggcggccgctctagaatagtggatcccccgggctgcaggaattcgcacgagaccattacctagaacatcctaatcgaaaactactccgtcactttgtttgcaaagctcctcctcgatccatcgatcactgcaccggccggcggcaccgcgctcgcaggggctagccaacgagacggcagcaatggcngaccgtggacgcagncgcatctacggcggcgcccacgcccacttacgggcagcancaacancaggggaggagcggggcccccaatggggtaaccaagggaaagggcattgctcaaaaaaaaggggcccaaagggtctccaaggggcctaaaaggggggaaaacctttttcccccttgggggggctttctttcttggtttttttgggggttggggcctaaaaaccccccccggggggggggtttggccctggccccaccccgggttttttcttaaatttttacccccccgggttgtggtcccccc

SEQ ID NO: 38492 - protein, 51 aa, Zea mays
  misc_feature: Ceres CLONE 1426912-F
  misc_feature (7)..(7): Xaa is any aa, unknown, or other
  misc_feature (21)..(21): Xaa is any aa, unknown, or other
  misc_feature (23)..(23): Xaa is any aa, unknown, or other
MADRGRXRIYGGAHAHLRAAXTXGEERGPQWGNQGKGHCSKKRGPKGLQGA

SEQ ID NO: 38493 - DNA, 669 bp, Zea mays
  misc_feature: Ceres CLONE 1426935-F
  misc_feature: Encodes the peptide sequence at SEQ ID NO. 38494
ctggagctccccgcggtggcggccgctctagaactagtggatcccccgggctgcaggaattcgcacgagaccattacctagaacatcctaatcgaaaagaaattttatctgtttaggagcttgatgggagcagcgcgcgcatagctaactactttgatgtcatcgctggcacaagcacaggtggtcttattgctgctatgctagcagctccgtcgctgagcaatgccaagcaaccatgctatgaggccaaggacatcgtgccattctacctcgagcacagtcctcgcatcttcccatgcagaactgggattttcggctggttcttcaagatcctacaaacagttaaggtgatgatcgggccaaaatatgacgggaagtacctgcacaaagtgaccagtgatctgctgggtggtaccagagtggaagagacgctgacaaatgtcgtcattcctactttcgatgtcaagtgcgtaaagccaacaatattcagcacattcaaggcgagatctagtgccttgatgaatgcccgtcttgctgatgtgtgcattggcacgtccgcagcaccgacggtcctccctgcgcactactttgaaaccgtggatcaccgcactggcgcatcgcgtagcttcaacgttatcgacgggggcctcgccgcaacaatccgactct

SEQ ID NO: 38494 - protein, 157 aa, Zea mays
  misc_feature: Ceres CLONE 1426935-F
  misc_feature (1)..(156): Pfam Name: Patatin Pfam Description: Patatin-like phospholipase
MLAAPSLSNAKQPCYEAKDIVPFYLEHSPRIFPCRTGIFGWFFKILQTVKVMIGPKYDGKYLHKVTSDLLGGTRVEETLTNVVIPTFDVKCVKPTIFSTFKARSSALMNARLADVCIGTSAAPTVLPAHYFETVDHRTGASRSFNVIDGGLAATIRL

SEQ ID NO: 38495 - DNA, 636 bp, Zea mays
  misc_feature: Ceres CLONE 1426936-F
  misc_feature: Encodes the peptide sequence at SEQ ID NO. 38496
  misc_feature (333)..(333): n is a, c, t, g, unknown, or other
  misc_feature (355)..(355): n is a, c, t, g, unknown, or other
  misc_feature (409)..(409): n is a, c, t, g, unknown, or other
  misc_feature (428)..(428): n is a, c, t, g, unknown, or other
  misc_feature (484)..(484): n is a, c, t, g, unknown, or other
  misc_feature (619)..(619): n is a, c, t, g, unknown, or other
ctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgncgtcgcccgcctccggcgccgncatccccggtggtgggaactcttcgtgacgcggcgcgaggacctagtcgagcangtgaagcacgccgcccggnaacgtgggcttcttcctgctggtgaacccaccgagtgcccgaagagctgatgggcngcatgctccgccgggtgcggcagttcaagagggccccccctggaaagcgaaaacaagcgctctaaatctcaaggaactgcgtgggaaacctggcctttccgcttcaacttccgacttctttcagggttgcctgcngccgaactggcgcgaca

SEQ ID NO: 38496 - protein, 79 aa, Zea mays
  misc_feature: Ceres CLONE 1426936-F
  misc_feature: SWISSPROT Homolog: EC 1.14.11.20 Desacetoxyvindoline 4-hydroxylase
  misc_feature (64)..(64): Xaa is any aa, unknown, or other
  misc_feature (71)..(71): Xaa is any aa, unknown, or other
MAPTTATKDDSGYGDERRRELQAFDDTKLGVKGLVDSGVKSIPSIFHHPPEALSDIISPAPLPXSPASGAXIPGGGNSS

SEQ ID NO: 38497 - DNA, 659 bp, Zea mays
  misc_feature: Ceres CLONE 1426944-F
  misc_feature: Encodes the peptide sequence at SEQ ID NO. 38498
  misc_feature (647)..(647): n is a, c, t, g, unknown, or other
ctggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaggctctgaagtcccctttgatgggcctattcgagaagcgcagagcaaggaacttcttcatttatgtccaagaattacatgaagctgatccaaggacacatcanggattggacctt

SEQ ID NO: 38498 - protein, 162 aa, Zea mays
  misc_feature: Ceres CLONE 1426944-F
  misc_feature (1)..(162): Pfam Name: GDI Pfam Description: GDP dissociation inhibitor
  misc_feature (158)..(158): Xaa is any aa, unknown, or other
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQELHEADPRTHXGLDL

SEQ ID NO: 38499 - DNA, 643 bp, Zea mays
  misc_feature: Ceres CLONE 1426954-F
  misc_feature: Translation starting site: 129
  misc_feature: SWISSPROT Homolog: EC 1.2.4.1 Pyruvate dehydrogenase (acetyl-transferring)
  misc_feature (341)..(341): n is a, c, t, g, unknown, or other
  misc_feature (404)..(404): n is a, c, t, g, unknown, or other
  misc_feature (409)..(409): n is a, c, t, g, unknown, or other
  misc_feature (410)..(410): n is a, c, t, g, unknown, or other
  misc_feature (433)..(433): n is a, c, t, g, unknown, or other
  misc_feature (541)..(541): n is a, c, t, g, unknown, or other
tccccgcggtggcggccgctctagaactagtggatcccccgggctgcaggaattcgcacgagaccattacctagaacatcctaatcgaaaatctgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgangccttgatggaagagatggaattagatcccacagtgtgtgtattttgtggaagatgtggccanttacnngttggtctaacaggtgaacaaangtttggctgatacgtttggagaccttcgagttctggacacccctaatgcgagaactcctttactggcatgggagttgaaccgggaattgaaaggctgaagcccgttcnttgaaagcatgaacatgggattccggctccctgtttacaaccgatcccaaataactgggggcatgctaattaactttccgggggccagtaaaatcccccttg

SEQ ID NO: 38500 - DNA, 673 bp, Zea mays
  misc_feature: Ceres CLONE 1426970-F
  misc_feature: Encodes the peptide sequence at SEQ ID NO. 38501
aaagctggagctccccgcggtggcggccgctctagaactagtggatcccccgggctgcaggaattcgcacgagaccattacctagaacatcctaatcgaaaactggagctttcttggtcaacaaacagcgcacttgaacttgtcctccttgtcctcctcgaaaacaccagccggcggccgactcgactcgactacttcaattcgtcgtagtgtgctccaagaaccaacagcacgctctccctctccccgacggctgctagctagcgacaacagatcgacggcaacaccgatgggcgaggccaacgccacaggcacgccagccaccgcgacggtgcgcgtgctggccgtgtcgcgcgtcgcgccggcgccggcgccggcagcggcggaccccgtcgtcgtcaagctgtccttcttcgacacgccctgggtcgtgctgccgcccatccagcgggtgttcctgtacgagctgcctggtggcgacggtgagttcacggcggcagtgacgcgcctcaagagctccctcgccgccacgctggcggtgtacctgccgctggccgggaagctggcgtacgtcgccggcacccggggacgtggtcgtggactgcgtcgacgaccccggggtggccttcgtcgaggcggaagcggacgccggtatcgacaccatggacgtccg

SEQ ID NO: 38501 - protein, 128 aa, Zea mays
  misc_feature: Ceres CLONE 1426970-F
  misc_feature: SWISSPROT Homolog: EC 2.3.1.153 Anthocyanin 5-aromatic acyltransferase
MGEANATGTPATATVRVLAVSRVAPAPAPAAADPVVVKLSFFDTPWVVLPPIQRVFLYELPGGDGEFTAAVTRLKSSLAATLAVYLPLAGKLAYVAGTRGRGRGLRRRPRGGLRRGGSGRRYRHHGRP

SEQ ID NO: 38502 - DNA, 622 bp, Zea mays
  misc_feature: Ceres CLONE 1426978-F
  misc_feature (157)..(157): n is a, c, t, g, unknown, or other
  misc_feature (172)..(172): n is a, c, t, g, unknown, or other
  misc_feature (173)..(173): n is a, c, t, g, unknown, or other
  misc_feature (196)..(196): n is a, c, t, g, unknown, or other
  misc_feature (331)..(331): n is a, c, t, g, unknown, or other
  misc_feature (336)..(336): n is a, c, t, g, unknown, or other
  misc_feature (340)..(340): n is a, c, t, g, unknown, or other
aaactggagctccccgcggtggcggccgctctagaactagtggatcccccgggctgcaggaattcgcacgagaccattacctagaacatcctaatcgaaaaatttcttctcctctctgctctgttcacttcgttctagtggggagcgccgccccccnccccttggcccaagnnttttggccccccggccccccggnccccccaacccccaaaggaaaaaggccccaagggttccccccaaccccctttccggggggtttcccttgggaattaaatgggggcccggcaacccccgggggggaaaagaggtgcaaaaggtttggcccaatcgncccgnttcnccttctccgtggcggcggcagcgggctgctgctctgcgcgtcagggcggcccatgcgctcgcgcttgcggcttgggcccccctcgccaccgaccgcagcaaaggggcactcggtcacccctcaaggccttgccccctcattggcaaccacaaacctcccccctggtggccccgcggaaaatcccaaaccccccccgggggggtgggggcccccgccccccccgcaaaatttcctggggcccccccccccccccggggaaggccaaaaaatccttcccccccg

SEQ ID NO: 38503 - DNA, 557 bp, Zea mays
  misc_feature: Ceres CLONE 1426990-F
  misc_feature: Translation starting site: 176
  misc_feature: SWISSPROT Homolog: EC 4.1.2.13 Fructose-bisphosphate aldolase
  misc_feature (214)..(214): n is a, c, t, g, unknown, or other
  misc_feature (311)..(311): n is a, c, t, g, unknown, or other
caaagctggagctcaccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatncagaatgctgcctacattggcaccccccggcagggtatccttgctgctgatgagtccactggcaccattggcaaacgcctttcccgcatcaatgtcnagaacgttgaggaaaaccgcctgccctccgtgagctccaattctgctggcctggggccttcccgtacatcaccggttggttccccttcaaggaaacccttgtaccaaaaaaccaggattgcgcacccttttttttaattcccccaggagggggggggccccccccggggcccaggggtgaaaaggcgcccctttgggtgtttttgcccctaaaaaagaaacccccccccggggccgaggaaacttt

SEQ ID NO: 38504 - DNA, 621 bp, Zea mays
  misc_feature: Ceres CLONE 1426992-F
  misc_feature: Encodes the peptide sequence at SEQ ID NO. 38505
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (143)..(143): n is a, c, t, g, unknown, or other
  misc_feature (400)..(400): n is a, c, t, g, unknown, or other
  misc_feature (432)..(432): n is a, c, t, g, unknown, or other
  misc_feature (433)..(433): n is a, c, t, g, unknown, or other
  misc_feature (496)..(496): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactccccgcggtggcggccgctctnagactagtggatcccccgggctgcaggaattcgcacgagaccattacctagaacatcctaatcgaaaatgcgtacattaagaagggagttgaggctgaggaaattgaagccctgtacaagaaggttcatgctgccatccgtgctgatccttcggttgttaagtcaaccaagcagccaccaaaggagcataagaggtacaaccccaagaagctgacatatgagcagaagaaagccagcccctcatgaagggctcaccnaactcactccctcggtggtgctgatgacgacnnatgagacgacgagtaaagtttagtgccatcgaaagtggtgctatctcaatcccagcgatcagncatttgtgtactggtcttatgcggggaacctgtagtactgcaataaggcattttttggttaaatttttggcaaggtgaacaaaaacctggtttccggtaaaatttccaaacctggaaccccccaa

SEQ ID NO: 38505 - protein, 27 aa, Zea mays
  misc_feature: Ceres CLONE 1426992-F
KLGLPAVAAALRLVDPPGCRNSHETIT

SEQ ID NO: 38506 - DNA, 674 bp, Zea mays
  misc_feature: Ceres CLONE 1426998-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (151)..(151): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (372)..(372): n is a, c, t, g, unknown, or other
  misc_feature (392)..(392): n is a, c, t, g, unknown, or other
  misc_feature (448)..(448): n is a, c, t, g, unknown, or other
  misc_feature (451)..(451): n is a, c, t, g, unknown, or other
  misc_feature (452)..(452): n is a, c, t, g, unknown, or other
  misc_feature (454)..(454): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagnactagtggatcccccgggctgcaggaattcgcacgagaccattacctagaacatcctaatcgaaaaatcccaatccagagcgaagatcgcgatcagagcaggagcaggcaacgcgcaccgaaatcttccannntcacagactcgctacttcgcagttggcagactcgcccgcagcgagccgctagcaaccaagcaaaaatgtccctggtgaggcccggcancgtgtttcaacccattcctncgtggacctcttcgaaccctttcaaagggtggtttccgctccatcgtgccgtctcntcnntnggggggggggggggggctcccaaaaacgcccgcccttttccccagggcccccttttaaatggggaaggggaaacccccaaaggcccccggtgttttaaagggccaaaccccccccggggggtaaaaaaaagagaagggtaaaagtgggggggggggagaaaaaaaaaaaaatgggttttttttcttaaacggggggggcgcccacaaaggggggaaaaag

SEQ ID NO: 38507 - DNA, 677 bp, Zea mays
  misc_feature: Ceres CLONE 1426999-F
  misc_feature: Encodes the peptide sequence at SEQ ID NO. 38508
aaagctggagctccccgcggtggcggccgctctagaactagtggatcccccgggctgcaggaattcgcacgagaccattacctagaacatcctaatcgaaaacttcaaaaatcaagttgattatgcggataccgcaaacactgcaaattcggttgttccctacccttctagagtaatctctccacacacacactcacacgctgctgccggctgccctcctcccgccccactcgtcccctccgaaccaagtccgatccatccatccccaaatttctcctctcagcgcgtggggcagtggcggcggcagcgtgggcgcgcggaccgctacgggcacgggagcagcggtggctgcgcaggcagctgtcagcatgcggcatggtgactacgggagcccaggcggcgccggtgcggctgcagccggcggcgggcgaccgtgaggcggctgcgggagcggtgaagtccggtggcgcctgctttgttttgtgttcctatttttgatttgcgaaaggatccaagagagagaggagggggagaaggcgagaatccaagacaagagcgagcatggagtttgctacgggtgccatgggtaccctcctccccaagctgggcatgctgctgcaggaagaactccacctgaagaaataatgtgaaggaggggatcaagagcctcactgccg

SEQ ID NO: 38508 - protein, 40 aa, Zea mays
  misc_feature: Ceres CLONE 1426999-F
MVTTGAQAAPVRLQPAAGDREAAAGAVKSGGACFVLCSYF

SEQ ID NO: 38509 - DNA, 664 bp, Zea mays
  misc_feature: Ceres CLONE 1427001-F
  misc_feature: Encodes the peptide sequence at SEQ ID NO. 38510
  misc_feature (499)..(499): n is a, c, t, g, unknown, or other
  misc_feature (500)..(500): n is a, c, t, g, unknown, or other
aaagctggagctccccgcggtggcggccgctctagaactagtggatcccccgggctgcaggaattcgcacgagaccattacctagaacatcctaatcgaaaaactgccctggtcccccattcaattcttccaactccgccgcttcgcctcgttccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgcgggggacctcgccaaactgcggctctccttcagagcgacccgcaggatgnnaaaaggggggcgggggaaggaaagggaaccgctacagcagctcttcgccgcgccgttggtggggctcatcaccaagcgtttctccgtgctctacgacgtcgaggcacgcaacgcgctgctccgcggagactgctcgctttccggaagcgccgtccagctccgtg

SEQ ID NO: 38510 - protein, 165 aa, Zea mays
  misc_feature: Ceres CLONE 1427001-F
  misc_feature (111)..(111): Xaa is any aa, unknown, or other
MASAAATTTSAPAQNLNPLSINIKLPPWLSGLRCPFTFVCPPPPPPPPPPPPPPPLPPTEPVVPRSRRLPSLRVTTEYDSEEGVFVNKVSCKLAGDLAKLRLSFRATRRMXKGGRGKEREPLQQLFAAPLVGLITKRFSVLYDVEARNALLRGDCSLSGSAVQLR

SEQ ID NO: 38511 - DNA, 712 bp, Zea mays
  misc_feature: Ceres CLONE 1427007-F
  misc_feature: Encodes the peptide sequence at SEQ ID NO. 38512
  misc_feature (667)..(667): n is a, c, t, g, unknown, or other
  misc_feature (712)..(712): n is a, c, t, g, unknown, or other
aaagctggagctcaccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcaacgagatcactggtcgggtggcggacgacaacacatggggaagggtagtgtgggtgcatcatggagggcgttcctcctgctcgccggcgtgctgctggtcgtaacacccacggccggggcggaggagggagtgttcgaacgggcccccaaggagaacctgcccgtggtgcaagaaggcggtgagagtggtattaccggaaacggcccccccggggaaaaagggaattggcaaaaccgagtggcccccaacccccccccaagaaaacttaaactcggggtaaaggaagggcgaactgggggtggggggaagcgcctttgctttctccccctttccccgaaaggggcacaaaatccccccgcccccccaagggtcctttggccccccccccacaagggggcgccgcactcctgggggggaaaacccccccaaatatatgttttttaggggggggggcgccccccgccaccccccaaataaatttggggncgtcgccctccctatggtgaagagcccaacacccccccgcgccgn

SEQ ID NO: 38512 - protein, 136 aa, Zea mays
  misc_feature: Ceres CLONE 1427007-F
MGKGSVGASWRAFLLLAGVLLVVTPTAGAEEGVFERAPKENLPVVQEGGESGITGNGPPGEKGNWQNRVAPNPPPRKLKLGVKEGRTGGGGKRLCFLPLSPKGAQNPPAPPRVLWPPPHKGAPHSWGGKPPQIYVF

SEQ ID NO: 38513 - DNA, 632 bp, Zea mays
  misc_feature: Ceres CLONE 1427013-F
  misc_feature: Encodes the peptide sequence at SEQ ID NO. 38514
aaagctggagctccccgcggtggcggccgctctagaactagtggatcccccgggctgcaggaattcgcacgagaccattacctagaacatcctaatcgaaaaacaacaacgagttaacgaaagccttttatccaagctcaggaaagctcacagtttcgttggatccaatcttagttttatccaagctcagcaatggcttctcgtcagcagcatcctactagctaccacgccggcgagacaaaggcccgtgccgaggagaagacgggtcaagtgatgggggcggcgcaggagaaagggagggaggccaagcacaaggcgtccgacgccgccgaccgcgccatggggatgggccacgacgccagggaggcgaccagggagaaggcgcgcgccgccgcggaccgaaccatggggatgggccacgacgccggggagacggccaaggacagggcgtaccgggccaggacgcggcctccggtgccgctgtccgcgccagggacactgcgtccgaacgcgccggcgctgccggggaccgcgcccacgacggcgcgcagcagaccgggagctacgtcgcgcagacggccgaggccccaggcaaaaggcggccggggccccgctgtaccccaaggaacccg

SEQ ID NO: 38514 - protein, 146 aa, Zea mays
  misc_feature: Ceres CLONE 1427013-F
MASRQQHPTSYHAGETKARAEEKTGQVMGAAQEKGREAKHKASDAADRAMGMGHDAREATREKARAAADRTMGMGHDAGETAKDRAYRARTRPPVPLSAPGTLRPNAPALPGTAPTTARSRPGATSRRRPRPQAKGGRGPAVPQGT

SEQ ID NO: 38515 - DNA, 706 bp, Zea mays
  misc_feature: Ceres CLONE 1427015-F
  misc_feature: Encodes the peptide sequence at SEQ ID NO. 38516
  misc_feature (458)..(458): n is a, c, t, g, unknown, or other
  misc_feature (513)..(513): n is a, c, t, g, unknown, or other
  misc_feature (516)..(516): n is a, c, t, g, unknown, or other
  misc_feature (517)..(517): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (561)..(561): n is a, c, t, g, unknown, or other
  misc_feature (591)..(591): n is a, c, t, g, unknown, or other
  misc_feature (592)..(592): n is a, c, t, g, unknown, or other
  misc_feature (595)..(595): n is a, c, t, g, unknown, or other
  misc_feature (618)..(618): n is a, c, t, g, unknown, or other
  misc_feature (625)..(625): n is a, c, t, g, unknown, or other
  misc_feature (648)..(648): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaatctgatgccgtaacacaaggctgaatttttgttcggtctagccgacccgacgatggcgtccagcgacgggaaaccactgccaaccccggcctctgttggggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctcccagtgcgccgtctatgactccgacaaagccgacgcgcgttctcatncggcgtgggagtaacatcgtgtccccagaaagaatctttccacttcgcttgcccngcnngaggaagccggggnnnnnnctgtggcactccacgccacagatancagtcaggccctgtgacgaagcccgcacgnntgncggggcttgcttgagaaaaggcngagcttngaccacatgggcccgcaccgttncgnnnaagtttcctgttgccccctgggcaggtgggacccggccggcgaccgccctgcc

SEQ ID NO: 38516 - protein, 52 aa, Zea mays
  misc_feature: Ceres CLONE 1427015-F
  misc_feature (1)..(52): Pfam Name: DUF1264 Pfam Description: Protein of unknown function (DUF1264)
MGAAAMQSLRPVKQAKQHMCTFALYAHDPKRQVETHHYVSRLNQDFLPVRRL

SEQ ID NO: 38517 - DNA, 659 bp, Zea mays
  misc_feature: Ceres CLONE 1427041-F
  misc_feature: Encodes the peptide sequence at SEQ ID NO. 38518
aaagctggagctccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgcccgcgcagcagcagccgcagccatggcaatacccactcaaccaccgcagctaaacccgtgacagcagttcgatcctgcggcgtcggcagcgtcggcagccggttccgggccagtgcgtccagtcccgaagaaccagtcaagcccggggggaaccccctaaggtttcccccaagtccaaggcccttaaacacaaatggtccccccaaaacgggaggggggacccctcccccgttacaaggaaaaaaagggggggggcccgggacccctctttaggaaaaaacccccggggggaaatccccgccctatatggggccccccgataacccacccctttaaggaaaaaatggcgcccc

SEQ ID NO: 38518 - protein, 63 aa, Zea mays
  misc_feature: Ceres CLONE 1427041-F
MKVLIVALALLALAASAASSTSGGCGCQTPPFHLPPPFYMPPPFYLPAQQQPQPWQYPLNHRS

SEQ ID NO: 38519 - DNA, 689 bp, Zea mays
  misc_feature: Ceres CLONE 1427048-F
  misc_feature: Encodes the peptide sequence at SEQ ID NO. 38520
  misc_feature (507)..(507): n is a, c, t, g, unknown, or other
  misc_feature (520)..(520): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaaatcgatgagatcatccatggctagttctctacttcagcagctgctgtctctgctgctgctcctgctgccctctcctcttcgtctccgggagcatctatcaggaaaccatgctgtcagtgccaacaacttccaccccatctttctggtaactggggtgagctgcagcgacctggaggcacgcctcaccgaggcgtaccggccgtcggtgccgcactgcggcgccatgaaggggaaggggtggttcggtctgtggaagaacagttcggagctgctgtctcatgactacgcgcagtgcttcgaggagcagatgagcctcgtctacgaccctgcccatcacgagtaccggaacctcgccggcgtcgagacgcgagtgcccaacttcggctccaccagagccttcagccnacagaaccctctncagtcagactggntgcctcggaaagctgaaagccccactgaaagacatgggataccgaaacggaaacccattgttcggagccccctaagatttcggttaaccgccggccgtcccccgggcaaaaatttcaaagggtccccccccctaccttcagggagcttaagggacc

SEQ ID NO: 38520 - protein, 190 aa, Zea mays
  misc_feature: Ceres CLONE 1427048-F
  misc_feature (130)..(130): Xaa is any aa, unknown, or other
  misc_feature (139)..(139): Xaa is any aa, unknown, or other
MASSLLQQLLSLLLLLLPSPLRLREHLSGNHAVSANNFHPIFLVTGVSCSDLEARLTEAYRPSVPHCGAMKGKGWFGLWKNSSELLSHDYAQCFEEQMSLVYDPAHHEYRNLAGVETRVPNFGSTRAFSXQNPLQSDWXPRKAESPTERHGIPKRKPIVRSPLRFRLTAGRPPGKNFKGSPPLPSGSLRD

SEQ ID NO: 38521 - DNA, 640 bp, Zea mays
  misc_feature: Ceres CLONE 1427054-F
  misc_feature (640)..(640): n is a, c, t, g, unknown, or other
tggagctccccgcggtggcggccgctctagaactagtggatcccccgggctgcaggaattcgcacgagaccattacctagaacatcctaatcgaaaaaccacgcttgcgtgaatgccctcgccgcctctccccgtgctcgcccaaatcgccgcctctccctccctgtcgcccctgcgccatggtgcttcacgccgttgaagtcacctcactcatcctgccgatgcagtcacccacaccgcctcctcccctccgctcaagccgcaccgcgacgtcagctgccagcaacgccctccccctcttaacaacgtcgcggcgtcctcgtgggctaacccccctccatcacttcttctcgccgagatgcacaacaccaggagctccatccaccttctccagcacccccacccccgctcaaatggtgtcgcgatgtccgccaccaacagcgccccttcccccctctcaaacaacgtcgcggcgtctgcgaattctagtaccggctgacagcggctgcggcgaagctatatgagaggtagcggagtactaaggggtggagagagggagcactgtctcagacatgaaagaaagtctccaaaacaaaagatttggtccagagtgcggccacatgagcccagcaatagcagn

SEQ ID NO: 38522 - DNA, 681 bp, Zea mays
  misc_feature: Ceres CLONE 1427063-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (287)..(287): n is a, c, t, g, unknown, or other
  misc_feature (294)..(294): n is a, c, t, g, unknown, or other
  misc_feature (355)..(355): n is a, c, t, g, unknown, or other
  misc_feature (388)..(388): n is a, c, t, g, unknown, or other
  misc_feature (401)..(401): n is a, c, t, g, unknown, or other
  misc_feature (402)..(402): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactccccgcggtggcggccgctctagactagtggatcccccgggctgcaggaattcgcacgagaccattaccagaacatcctaatcgaaaatcaccaccactgggtcttcagaccattagcttatctactccagagcgcagaagacccgatcgacaccatgagggtngtgctcngtgccctcgctctcctggctctcgctgcgagcgccacctcacgcatacagcggcggctgcngctgccagccacgccgcgggtcatctacggcgncggggcatctgcnnactcgggtcaccttgcacctcgggggatcttcaacgcgcggccacctggcgccgccgggccactgcaacccccggtccattgtccccccccgtttatttgccccccccccctgccttaacctttttaaacgccccggggtcttgcccttttcccgggaaaaccctgggcccgtgcaaaaagccggtttaaaaacccggggcacattttgagggaaaacccggggggtttgggaaccaccccccaaattctggggcaaaggggggcaaaaattccttaga

SEQ ID NO: 38523 - DNA, 550 bp, Zea mays
  misc_feature: Ceres CLONE 1427065-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (323)..(323): n is a, c, t, g, unknown, or other
  misc_feature (325)..(325): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagactgggactccaccgcggtgggcggccgctctagaactagtggatcccccgggctgcaggaattcgcacgagaccattacctagaacatcctaatcgaaaagtttcggcggcgccggcgtgctcgtgatctcaacccaagggcgtgcctccgctccggtcacccgtcgctccacgcaaccattgtccgaggaagaaagacagggagcccnanggaggagaacgtcacccctgggacccacctgtccgtggagggaaaatatgtcctttgggggtcccctcacatcctttgcctccctttaatggagaacccttccttccaaaaccacggaaatttggcccgggggaagggaaaaaactcttgggtttccggaaaaaaacccggggggggcccttttaaaagggggaaaaggggcttaaaacccctgtaaaaaaaaaa

SEQ ID NO: 38524 - DNA, 696 bp, Zea mays
  misc_feature: Ceres CLONE 1427066-F
  misc_feature: Encodes the peptide sequence at SEQ ID NO. 38525
  misc_feature (360)..(360): n is a, c, t, g, unknown, or other
  misc_feature (423)..(423): n is a, c, t, g, unknown, or other
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaaaacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggtgagggtctggatctagcaatggcggaaaacacccacggtagtggtcgccacgtgcttggggacttgacaaatgttatttgncagcgagcagccacatcagatctggagaagagtacaggtggggataaagatcagacgggattngaaagactgggactaggaaagagtacgatgcaaatgcaaaagctagcagntatggggaaaaggattggattttggcaatttgtttggatgatgtttgccaaaaagaaatttccaaagcctttcctatctttcaaaaaaaggagggttcaaaccaaaaacctcccaaaaaccccggtgacttttttcccagggagccccttggcttcaaaaaaaccccttggcgcccccggggccccttaattccccggggaagggggggggggttttcccctt

SEQ ID NO: 38525 - protein, 121 aa, Zea mays
  misc_feature: Ceres CLONE 1427066-F
  misc_feature (21)..(21): Xaa is any aa, unknown, or other
  misc_feature (42)..(42): Xaa is any aa, unknown, or other
  misc_feature (59)..(59): Xaa is any aa, unknown, or other
MAENTHGSGRHVLGDLTNVIXQRAATSDLEKSTGGDKDQTGXERLGLGKSTMQMQKLAXMGKRIGFWQFVWMMFAKKKFPKPFLSFKKRRVQTKNLPKTPVTFFPGSPLASKKPLGAPGAP

SEQ ID NO: 38526 - DNA, 664 bp, Zea mays
  misc_feature: Ceres CLONE 1427087-F
  misc_feature: Encodes the peptide sequence at SEQ ID NO. 38527
  misc_feature (360)..(360): n is a, c, t, g, unknown, or other
  misc_feature (381)..(381): n is a, c, t, g, unknown, or other
  misc_feature (384)..(384): n is a, c, t, g, unknown, or other
  misc_feature (385)..(385): n is a, c, t, g, unknown, or other
  misc_feature (395)..(395): n is a, c, t, g, unknown, or other
  misc_feature (399)..(399): n is a, c, t, g, unknown, or other
  misc_feature (405)..(405): n is a, c, t, g, unknown, or other
  misc_feature (406)..(406): n is a, c, t, g, unknown, or other
  misc_feature (416)..(416): n is a, c, t, g, unknown, or other
  misc_feature (446)..(446): n is a, c, t, g, unknown, or other
  misc_feature (447)..(447): n is a, c, t, g, unknown, or other
  misc_feature (504)..(504): n is a, c, t, g, unknown, or other
  misc_feature (539)..(539): n is a, c, t, g, unknown, or other
  misc_feature (578)..(578): n is a, c, t, g, unknown, or other
caaagctggagctccccgcggtggcggccgctctagaactagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcggcagccgtccacgccgcccccgccgcctcggcgccggcgccagcgcgcgcgacgccgcgctcaccgcctccgtgccaggaccggncgcccaggggaacggaagaanganngagggactcnttgnaggccnnacccggacgncggacgacgttctggcgcgggctgcagcanncacgggaagcgggaggcgtggctgcggcgggcgtcaaggcccgttggttggtggtcnccggccaagaaggggtcccctccggacgcctccgnccgctcgggggaaaacggcggggttggggaagggcccgnaacctgaccgacaacgacctggaggagctcaagggggtgcgtggatctggggttcgggcttcgcttaccgcaagatccccgagctg

SEQ ID NO: 38527 - protein, 129 aa, Zea mays
  misc_feature: Ceres CLONE 1427087-F
  misc_feature (62)..(62): Xaa is any aa, unknown, or other
  misc_feature (63)..(63): Xaa is any aa, unknown, or other
  misc_feature (64)..(64): Xaa is any aa, unknown, or other
  misc_feature (67)..(67): Xaa is any aa, unknown, or other
  misc_feature (68)..(68): Xaa is any aa, unknown, or other
  misc_feature (71)..(71): Xaa is any aa, unknown, or other
  misc_feature (74)..(74): Xaa is any aa, unknown, or other
  misc_feature (84)..(84): Xaa is any aa, unknown, or other
  misc_feature (115)..(115): Xaa is any aa, unknown, or other
  misc_feature (128)..(128): Xaa is any aa, unknown, or other
MWSSGSDRDEALDTANASSVDASSPARQPSTPPPPPRRRRQRARRRAHRLRARTGRPGERKXXXGTXXRPXPDXGRRSGAGCSXHGKREAWLRRASRPVGWWSPAKKGSPPDASXRSGENGGVGEGPXT

SEQ ID NO: 38528 - DNA, 634 bp, Zea mays
  misc_feature: Ceres CLONE 1427090-F
  misc_feature (264)..(264): n is a, c, t, g, unknown, or other
  misc_feature (267)..(267): n is a, c, t, g, unknown, or other
aaactggagctccccgcggtggcggccgctctagaactagtggatcccccgggctgcaggaattcgcacgagaccattacctagaacatcctaatcgaaaactcctgaacacaccacccctcgtctccccacggaggccgtcctctcctctcctctgcgtccgccactgcccaccgctcgcccgcgcgcgctccattacctcggcgggcgatggccgacctatccaacaccggctcccacctacacgagcagcgccccgcctangcngcagctggctggtcggtcgtccagcaactagcggcggcagcggccggaagggaaggcgtctcactctcctcgtcggggccgcaagagatggaagccatcctgggcttcccgcgccccccccgtggccctgcctctggccccccttcagaaaacgcgccgcggcgcttggtgcgccaaaattccaaaaggcgaagctcctccggtcccgcggaaaaggccccgaaaaattgtggcttctgggggccccataacccgaaggggccccgatactcggcttccccttgtgcccgcgcaatattgtaggaacagggaagggcccctactcttgggcatgatgacctctcttactaccaggcacaaaagcccc

SEQ ID NO: 38529 - DNA, 619 bp, Zea mays
  misc_feature: Ceres CLONE 1427094-F
  misc_feature (202)..(202): n is a, c, t, g, unknown, or other
  misc_feature (239)..(239): n is a, c, t, g, unknown, or other
  misc_feature (240)..(240): n is a, c, t, g, unknown, or other
  misc_feature (335)..(335): n is a, c, t, g, unknown, or other
aaagctggagctccccgcggtggcggccgctctagaactagtggatcccccgggctgcaggaattcgcacgagaccattacctagaacatccaaatcgaaaaagcgagcgagagagacgcacatctatctgtcaagcgacgccgcggcctcgatcagagtcggaggcgaacacccccatggcggcggctggcggcggcgcanggagggaggtatcctttcagatcatcctcacctccgnnacccagctcccttttcaagtgtccagcgtgccccgaggcggcgcccttttaccgcggtgcctcagtacgcccgcggaggaagttcagggtcccgncccccagacagcgccatcattccccaaggatgggatttggccttcaaccccagccaaagtgcaggcaccgtggtttctgaaaacctgggttgggagttgggttttcaaccccttcgcaaaaaggtttgaaccctgaacccctgggctcccggggtgaggggaattttcccgccccctggcgttagggggcaaaaatttggaagaaaaaaagcctttttgtgttgggcccttcttgggcgttagaaagttttttttcccgggggtttaacccgaccctttccccc

SEQ ID NO: 38530 - DNA, 567 bp, Zea mays
  misc_feature: Ceres CLONE 1427095-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (122)..(122): n is a, c, t, g, unknown, or other
  misc_feature (128)..(128): n is a, c, t, g, unknown, or other
  misc_feature (130)..(130): n is a, c, t, g, unknown, or other
  misc_feature (131)..(131): n is a, c, t, g, unknown, or other
  misc_feature (143)..(143): n is a, c, t, g, unknown, or other
  misc_feature (153)..(153): n is a, c, t, g, unknown, or other
  misc_feature (287)..(287): n is a, c, t, g, unknown, or other
  misc_feature (390)..(390): n is a, c, t, g, unknown, or other
  misc_feature (391)..(391): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttnnnnnnnccaaagctggggactccaccncggggngnncggccgctctanaactagtggnattccccgcgggctgcaggaaattcgcacgagaccattacctagaacatactaatcgaaaaatccgttgatcccatcggcttccccttcctcttcctcgatccccttcctcccccgatcccatccaattccacnttccacaccccgggccctccgcccgccgaacgccgaacgccaacgcccgccggggccatgtccccagttacgggcacccattttccaaccttccttcctttcnngggggccggaagggcccccgtttgcccccttggggggggggggccccccccccccgtgctcaaattttccctttccccccgggcgaccaaaaagggtttcgggggggggccccctgggggctttttgggaaaaaaaccccccccggggccccctttttgggggggagggactcttc

SEQ ID NO: 38531 - DNA, 655 bp, Zea mays
  misc_feature: Ceres CLONE 1427096-F
  misc_feature: Encodes the peptide sequence at SEQ ID NO. 38532
  misc_feature (413)..(413): n is a, c, t, g, unknown, or other
  misc_feature (417)..(417): n is a, c, t, g, unknown, or other
ggagctccccgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcgcggccgtcgtttgcggcgataggcggttctcgtggcgcgagacgagggagcggtgcctcgccggggcagccgctctcgctcgtctcggcgttggccgccgcgacgtggtcgcggtcatcgcctcgaacgtaccggcgatgtacgagctccatttcagcgtgccgatgaccggcgccgtcctgtncacnctcaacacccgccacgacgcggccatggtgtccgtcctgctgaaacactcggaagccaaggtcttcctcgtggagtcgcagttccacgccgtggcccgcgacgcgctcaggctcctcgccgacgccaaagacaggcttcctctcgtcatcacggtttctgaccctagcagcagcagcaccggcgggcggctgcggcagcaacaacggcagcgtcgcggtcgcggagtacgaaccgctg

SEQ ID NO: 38532 - protein, 172 aa, Zea mays
  misc_feature: Ceres CLONE 1427096-F
  misc_feature: SWISSPROT Homolog: EC 6.2.1.26 o-succinylbenzoate--CoA ligase
  misc_feature (92)..(92): Xaa is any aa, unknown, or other
MDGSMWCAANYVPLTPLSFLERAAVVYGDRAAVVCGDRRFSWRETRERCLAGAAALARLGVGRRDVVAVIASNVPAMYELHFSVPMTGAVLXTLNTRHDAAMVSVLLKHSEAKVFLVESQFHAVARDALRLLADAKDRLPLVITVSDPSSSSTGGRLRQQQRQRRGRGVRTA

SEQ ID NO: 38533 - DNA, 597 bp, Zea mays
  misc_feature: Ceres CLONE 1427102-F
  misc_feature: Encodes the peptide sequence at SEQ ID NO. 38534
aagctggagctccccgcggtggcggccgctctagaactagtggatcccccgggctgcaggaattcgcacgagaccattacctagaacatcctaatcgaaaaatcacctataatattttgagcatttagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgttcttacaacaccaattggcccatttgcaaacaaacaattcccttggggcacattcctaaacaaataaccaaaacccattttcgaaaaacggccaaaaaaagggcaaaaaaaaaaaagaggtttccccctaaccccccgggcccttgttgggggacccccccccctttagacccccgggggggggggggaaaaaaccccccggtgggtggcccgccccctcaattattttgtgga

SEQ ID NO: 38534 - protein, 86 aa, Zea mays
  misc_feature: Ceres CLONE 1427102-F
MATKILSLLALLALFASATNASIIPQCSLAPSSIIPQFLPPVTSMAFEHPAVQAYRLQQAIAASVLTTPIGPFANKQFPWGTFLNK

SEQ ID NO: 38535 - DNA, 583 bp, Zea mays
  misc_feature: Ceres CLONE 1427105-F
  misc_feature: Encodes the peptide sequence at SEQ ID NO. 38536
  misc_feature (432)..(432): n is a, c, t, g, unknown, or other
  misc_feature (443)..(443): n is a, c, t, g, unknown, or other
  misc_feature (544)..(544): n is a, c, t, g, unknown, or other
ctccaccgcggtggcggccgctctagaactagtggatcccccgggctgcaggaattcgcacgagaccattacctagaacatcctaatcgaaaagaacgagcgaggccacgaggtgcccgccgcgcccagccggcctcgccgaccgggcccgccggcccctatataggcaggcgccacttcctcctcgcaaccaccagacgccagtccaccaccgcttcccgtgcagcgccctccctatacgttcccccatttcctgtgttggcggcgatggcgcggcacttcgtgctcaacaccggcgccaagatcccctccgtggggctcggcacctggcagtctgaccccggcgtcgttgggcacgctgtctacgccgcccgtcaggcgggtaccgacatatcgattgtgcagagtttacggcaacgaaaggagattggngttgcgctaanaagctatttgaagaggtgtagtgaacgaaaagatatgttatcacctctagctatggaatgatcacatgctccctgagatgggcctgaggcactaaatgacngctggatgaattgcagcttgaataactggatctttacct

SEQ ID NO: 38536 - protein, 78 aa, Zea mays
  misc_feature: Ceres CLONE 1427105-F
  misc_feature: SWISSPROT Homolog: EC 1.1.1.21 Aldehyde reductase
  misc_feature (59)..(59): Xaa is any aa, unknown, or other
MARHFVLNTGAKIPSVGLGTWQSDPGVVGHAVYAARQAGTDISIVQSLRQRKEIGVALXSYLKRCSERKDMLSPLAME

SEQ ID NO: 38537 - DNA, 660 bp, Zea mays
  misc_feature: Ceres CLONE 1427106-F
  misc_feature: Encodes the peptide sequence at SEQ ID NO. 38538
  misc_feature (534)..(534): n is a, c, t, g, unknown, or other
  misc_feature (535)..(535): n is a, c, t, g, unknown, or other
  misc_feature (547)..(547): n is a, c, t, g, unknown, or other
  misc_feature (552)..(552): n is a, c, t, g, unknown, or other
  misc_feature (559)..(559): n is a, c, t, g, unknown, or other
  misc_feature (560)..(560): n is a, c, t, g, unknown, or other
  misc_feature (574)..(574): n is a, c, t, g, unknown, or other
  misc_feature (602)..(602): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaactctcgttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatcccccaagacatggagaactacaggctgctttatgacaccaaggggcgcttccgtcnntcaccatcaggnatgangatgccnnagtcagctctgcanggtgagggtctgtcagttttggcagaanggcatcccctactgaancactacgacgggcgcaccatccgctaccccgacccgctcat

SEQ ID NO: 38538 - protein, 152 aa, Zea mays
  misc_feature: Ceres CLONE 1427106-F
  misc_feature (3)..(40): Pfam Name: RS4NT Pfam Description: RS4NT (NUC023) domain
  misc_feature (111)..(111): Xaa is any aa, unknown, or other
  misc_feature (117)..(117): Xaa is any aa, unknown, or other
  misc_feature (120)..(120): Xaa is any aa, unknown, or other
  misc_feature (124)..(124): Xaa is any aa, unknown, or other
  misc_feature (134)..(134): Xaa is any aa, unknown, or other
  misc_feature (139)..(139): Xaa is any aa, unknown, or other
MARGLKKHLKRLNAPKHWMLDKLGGAFAPKPSSGPHKSRECLPLILIIRNRLKYALNYREVISILMQRHVLVDGKVRTDKTYPAGFMDVISIPQDMENYRLLYDTKGRFRXSPSGMXMPXSALXGEGLSVLAEXHPLLXHYDGRTIRYPDPL

SEQ ID NO: 38539 - DNA, 666 bp, Zea mays
  misc_feature: Ceres CLONE 1427108-F
  misc_feature: Encodes the peptide sequence at SEQ ID NO. 38540
atagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcaccagcagggaggaggcgggcgccccatgggtgagcaggtgaagggcatgctccacgacaaggggccgacggcgtcccacgcgctgacggtggtgacgctgttcccgctgggcaggctgctgctggtgctgacagggctggcgctgactgcctccgtggtggggctggccgtggccacaccggtgttcctgatcttcagccccgtgctcgtccccgccgcgctgctcatcaggacggccgtcatggggttcctcacgtccggcgcgctggggctcgggggcctgtcctcgctcacgtgcctcgacaacactgtgcggcaggcgttccagcgcaccccggactacgtggaggatgcaccacgcaagatggccgaggccgctacgcacgcgagccactagac

SEQ ID NO: 38540 - protein, 152 aa, Zea mays
  misc_feature: Ceres CLONE 1427108-F
  misc_feature (44)..(150): Pfam Name: Oleosin Pfam Description: Oleosin
MADRDRSGIYGGAHATYGQQHQQGGGGRPMGEQVKGMLHDKGPTASHALTVVTLFPLGRLLLVLTGLALTASVVGLAVATPVFLIFSPVLVPAALLIRTAVMGFLTSGALGLGGLSSLTCLDNTVRQAFQRTPDYVEDAPRKMAEAATHASH

SEQ ID NO: 38541 - DNA, 670 bp, Zea mays
  misc_feature: Ceres CLONE 1427109-F
  misc_feature: Encodes the peptide sequence at SEQ ID NO. 38542
aaagctggagctccccgcggtggcggccgctctagaactagtggatcccccgggctgcaggaattcgcacgagaccattacctagaacatcctaatcgaaaaaatgccactgtgagtctgtgaccacaccaaacgccggcggagtcgtcagtcgtgcgtgcccgtcccgttctgcccccacctcccctcccccgactccctcactcttcctcttccgttccatttcaagatccctgcagccgtccgtccatccatccatccatccatccgttaagaggagaggggaagccggccggccggccggccggtggagcggagatgagggggcagacagagacaggccggtggcgaggaggcgacggcgctgcggcgtggtgggtggccgtggtggccctgcagctgggccattcactgagccgcgcgcgggcggggctgctggagtccaacccgggcctggcctacaacttctaccagagcagctgccccagcgcggagtccatcgtccgcagcgtcacctgggcgcaggtcgccgccgaccccgcgctcccggcccgcctcctccgcctccacttccatgactgcttcgtcaagggctgcgacgcgtcgatcctgctggacaacgcgcagagcgagaagacggcggcgccgaacctgtcggtgggcgggtacc

SEQ ID NO: 38542 - protein, 117 aa, Zea mays; identical to SEQ ID NO: 38476
  misc_feature: Ceres CLONE 1427109-F
  misc_feature: SWISSPROT Homolog: EC 1.11.1.7 Peroxidase

SEQ ID NO: 38543 - DNA, 651 bp, Zea mays
  misc_feature: Ceres CLONE 1427116-F
  misc_feature: Encodes the peptide sequence at SEQ ID NO. 38544
tccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgccacctgcttaccacttggatcctggctccggagcgggcagcagaagctggattgtgaacttagagggaggtgcgtggtgcaacagcgccaagacatgccggctcaccaggagctccggccgtggctcgtcggaccacatggacaaagagatccccttcaccggcatcatgagcagcagccgtaccgtgaatcctggtctcgcccgattctaatttctacatctggaaccgggtcaaggttcg

SEQ ID NO: 38544 - protein, 146 aa, Zea mays; identical to SEQ ID NO: 37797
  misc_feature: Ceres CLONE 1427116-F
  misc_feature (41)..(147): Pfam Name: PAE Pfam Description: Pectinacetylesterase

SEQ ID NO: 38545 - DNA, 666 bp, Zea mays
  misc_feature: Ceres CLONE 1427117-F
  misc_feature (422)..(422): n is a, c, t, g, unknown, or other
  misc_feature (518)..(518): n is a, c, t, g, unknown, or other
  misc_feature (551)..(551): n is a, c, t, g, unknown, or other
aagctggagctccccgcggtggcggccgctctagaactagtggatcccccgggctgcgcgaattcccacgagaccattacccaaaacatcctaatcgaaaaaccacgcttgcgtgaatgccctcgccgcctctccccgtgctcgcccaaatcgccgcctctccctccctgtcgcccctgcgccatggtgcttcacgccgttgaagtcacctcactcatcctgccgatgcagtcacccacaccgcctcctcccctccgctcaagccgcaccgcgacgtcagctgccagcaacgccctccccctcttaacaacgtcgcggcgtcctcgtgggctaacccccctccatcacttcttctcgccgagatgcacaacaccaggagctccatccaccttctccagcacccccacccccgctcaaatggntgtcgcgatgtccgccaccaacagcgccccttcccccctctcaaaacaacgtcgcggcgtctgcgaaattctagtacccggctgacagcggctgcngcgaagctatatgagaggtagcggagtactaangggtggaagagaaggagcacttgtctcagacatgaaaagaagtctcaaaacaaaagatttggtccagagtgcggccacatgagccagcaatagcagcgccacatggtagtggcca

SEQ ID NO: 38546 - DNA, 688 bp, Zea mays
  misc_feature: Ceres CLONE 1427120-F
  misc_feature: SWISSPROT Homolog: EC 1.14.11.20 Desacetoxyvindoline 4-hydroxylase
  misc_feature (1)..(1): n is a, c, t, g, unknown, or other
naaagctggagctcaccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgaacaacacgaagctgggggtgaaaggtctggtggactccggcgtcaagtccatcccgtccatcttccaccacccgccggaagccctgagcgacataatttctccggcgcctcttgccgcgtcggcgcccttcggcgccggcattccggttgtggaactctccgtgacgcggcgcgaagacctagtccagcaagtgaagcacgccgcccggaccgttggcttcttcttgcttgtgaaccaccgaattgccgaagaacttattggccgcatgcttcgcggggtgcgccagttcaacaggcccccctgggagagagaaaacaaagcgctctatatctagagaactctcgttggaaaactgtgcgttttcgctctccaactttcaaacttctttcaaggcttgctgcgcggccgaacttgggcgcgacacgctcctttctctggcaaagttgggcttcccgaaacccgggc

SEQ ID NO: 38547 - DNA, 638 bp, Zea mays
  misc_feature: Ceres CLONE 1427123-F
  misc_feature (157)..(157): n is a, c, t, g, unknown, or other
  misc_feature (193)..(193): n is a, c, t, g, unknown, or other
  misc_feature (203)..(203): n is a, c, t, g, unknown, or other
  misc_feature (209)..(209): n is a, c, t, g, unknown, or other
  misc_feature (241)..(241): n is a, c, t, g, unknown, or other
  misc_feature (248)..(248): n is a, c, t, g, unknown, or other
  misc_feature (270)..(270): n is a, c, t, g, unknown, or other
  misc_feature (273)..(273): n is a, c, t, g, unknown, or other
ggagctccccgcggtggcggccgctctagaatagtggatcccccgggctgcaggaattcgcacgagaccattacctagaacatcctaatcgaaaacttgtttcctggcggcgacggctggtcgagcggcgccgcccttgggctagtcttcgctgggntcttcccggcgacgagcgtcccatctgggtcgactngactgagcangcatangaagagaaactatgttgttcttcttctacttncaagagnctgtggggaaaggagtgacaantgnaactcaaaattgaatttgggaatcccggggaacttccctctggttgtaccagacttctaaatcaagtcgggaaaacccccgtaatctacaaggaaaaaaattccccaatgttttttttgtgggaaaatcttttttagggggtccttggggggggaatatcttgtttccccccgaagggggtgggaatattaaatcttcctctaaaacccccccaaggggaggggcgcggggggggttttcttatttttggccccccccccccccccctcgggggggggggggtttttttcccccttttattgaacaaacgcttgctttgggggtggggtggaaacaaaccccccccctttttttttttttgttgt

SEQ ID NO: 38548 - DNA, 662 bp, Zea mays
  misc_feature: Ceres CLONE 1427124-F
  misc_feature: Encodes the peptide sequence at SEQ ID NO. 38549
ggagctccccgcggtggcggccgctctagaactagtggatcccccgggctgcaggaattcgcacgagaccattacctagaacatcctaatcgaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcgcccatcaccgtgccagttggcagggct

SEQ ID NO: 38549 - protein, 161 aa, Zea mays
  misc_feature: Ceres CLONE 1427124-F
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRA

SEQ ID NO: 38550 - DNA, 666 bp, Zea mays
  misc_feature: Ceres CLONE 1427136-F
  misc_feature: Encodes the peptide sequence at SEQ ID NO. 38551
  misc_feature (412)..(412): n is a, c, t, g, unknown, or other
  misc_feature (459)..(459): n is a, c, t, g, unknown, or other
  misc_feature (475)..(475): n is a, c, t, g, unknown, or other
  misc_feature (517)..(517): n is a, c, t, g, unknown, or other
  misc_feature (524)..(524): n is a, c, t, g, unknown, or other
  misc_feature (590)..(590): n is a, c, t, g, unknown, or other
tccccgcggtggcggccgctctagaactagtggatcccccgggctgcaggaattcgcacgagaccattacctagaacatcctaatcgaaaaagaccaccactgcgccattggccagctagagccaaccagaagagcttgcagttactgagagtgtgtgtgagagagaggatgggtggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgcccagggagcttgggcccaagccggagaagccgcccaaggagcacaagccgaccccncccacgtacaccccgagccccgaacccacgccgccgacgtacagtcncaccccgacgcccccnaagccgacgccgcctacatacattgccgcccctacgcgccanagacccngaccaaaaccgcgctccaagccctcccacgaacacgccgacccccaagccctcctacccctaagcnggacccccccctacttacacctccaggccccccgcactcagacttccaaagcccgacccccatcgtacattatttt

SEQ ID NO: 38551 - protein, 165 aa, Zea mays
  misc_feature: Ceres CLONE 1427136-F
  misc_feature (97)..(97): Xaa is any aa, unknown, or other
  misc_feature (116)..(116): Xaa is any aa, unknown, or other
  misc_feature (119)..(119): Xaa is any aa, unknown, or other
  misc_feature (141)..(141): Xaa is any aa, unknown, or other
MGGSGRAALLLALVVVAVSLAVEIQADAGYGYGGGYTPTPTPATPTPKPEKPPTKGPKPDKPPRELGPKPEKPPKEHKPTPPTYTPSPEPTPPTYSXTPTPPKPTPPTYIAAPTRXRPXPKPRSKPSHEHADPQALLPLSXTPPYLHLQAPRTQTSKARPPSYII

SEQ ID NO: 38552 - DNA, 662 bp, Zea mays
  misc_feature: Ceres CLONE 1427138-F
  misc_feature: Encodes the peptide sequence at SEQ ID NO. 38553
  misc_feature (607)..(607): n is a, c, t, g, unknown, or other
atagctggagctccccgcggtggcggccgctctataactagtggatcccccgggctgcaggatattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgctggccgccgaggaccagctgcggcaccccctcgcgcgccgccgcgaggacgcccgcgccaacgcccgcgccgccgagatcttcgcgggccaccgcgccgcctggatggaggccgagcgccgcctgcaggcccgcgccgccgccgccgcggacgaggccgcctccctccgcgcgcacctcgtcgacgccgaaggcgacgccgctgccctgcgcgcccccnccgagcgactcgagcgccaggccacccagcgggatgagctgctcaccccgctcct

SEQ ID NO: 38553 - protein, 159 aa, Zea mays
  misc_feature: Ceres CLONE 1427138-F
  misc_feature (142)..(142): Xaa is any aa, unknown, or other
MAAESARPPSPPRDSGCPAGAGDSTSSQLTATYLGVSFALFLATLPSGTAARHVASLQSRGRLLASRLLAAEDQLRHPLARRREDARANARAAEIFAGHRAAWMEAERRLQARAAAAADEAASLRAHLVDAEGDAAALRAPXERLERQATQRDELLTPL

SEQ ID NO: 38554 - DNA, 682 bp, Zea mays
  misc_feature: Ceres CLONE 1427150-F
  misc_feature: Encodes the peptide sequence at SEQ ID NO. 38555
  misc_feature (317)..(317): n is a, c, t, g, unknown, or other
  misc_feature (387)..(387): n is a, c, t, g, unknown, or other
  misc_feature (388)..(388): n is a, c, t, g, unknown, or other
caaagctggagctccccgcggtggcggccgctctagaactagtggatcccccgggctgcaggaattcgcacgagaccattacctagaacatcctaatcgaaaaagaatgctctagtgacagcgaaaaaaccaaacaacaaaaaccaacgaaatccctgccatttttataggagacgacggtgcggggacaccacgctcccgcattcagtccctccagtcgttgcgtcggacgccgttgagcgttggtggcactgtgccagcagcagcgcgccgcgggtggcaaggcaaagggggcgacgaagaggaaagcgaagaanacgtcatggggcttggccttggcgtgcgggcggcgcccttcacgtacgcggcgcacgcgctggccgtcgnncgcgcggccatgggtgttgtctgggccatctacttccggcgtgggctcgccatcgaggccaccaacagaaacctcatctcaacgttcaccctggtcttaagcttatcgggtaaattaaccatcggcggccaaactttaatgggtaaagggttactcccaacttcgaaccccgaaaaaaataggctgatcctttctagtttcccccggatttgcccttgcccttggggcggtgggaaaatatttcccccttcaaaaatctaaaggaaggggggattcccaatttttcaaggtggc

SEQ ID NO: 38555 - protein, 108 aa, Zea mays
  misc_feature: Ceres CLONE 1427150-F
  misc_feature (22)..(22): Xaa is any aa, unknown, or other
MGLGLGVRAAPFTYAAHALAVXRAAMGVVWAIYFRRGLAIEATNRNLISTFTLVLSLSGKLTIGGQTLMGKGLLPTSNPEKNRLILSSFPRICPCPWGGGKIFPPSKI

SEQ ID NO: 38556 - DNA, 605 bp, Zea mays
  misc_feature: Ceres CLONE 1427157-F
  misc_feature: Encodes the peptide sequence at SEQ ID NO. 38557
  misc_feature (363)..(363): n is a, c, t, g, unknown, or other
  misc_feature (364)..(364): n is a, c, t, g, unknown, or other
aaagctggagctccccgcggtggcggccgctctagaactagtggatcccccgggctgcaggaattcgcacgagaccattacctagaacatcctaatcgaaaaatttttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtgggtcaagttctctggggttactctttggaagcggtgagcccccccaaaccagcagtggcaccagctggtagtgctccacctgctgctgcaggtgctcccactgctgagaacnncactgctggcaagcctgatggcaccagtcagattgctgctggggtaccggccaacccattaactccccaggggccgacgtccgaacaccgggaaatttccttaaggaacgttctttgaacaaaggtccagctggtcccgggcggggggcccttccccgggaaacccgggttggggggaattgatgcccgcttaccaagttttcccccccccattggccccccagggttttttttgaatcgt

SEQ ID NO: 38557 - protein, 32 aa, Zea mays
  misc_feature: Ceres CLONE 1427157-F
MSRGGSAGGGSSSLGLLFGSGEPPQTSSGTSW

SEQ ID NO: 38558 - DNA, 600 bp, Zea mays
  misc_feature: Ceres CLONE 1427161-F
  misc_feature: Encodes the peptide sequence at SEQ ID NO. 38559
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (448)..(448): n is a, c, t, g, unknown, or other
  misc_feature (501)..(501): n is a, c, t, g, unknown, or other
  misc_feature (514)..(514): n is a, c, t, g, unknown, or other
  misc_feature (519)..(519): n is a, c, t, g, unknown, or other
  misc_feature (560)..(560): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagctgggactccccgcggtggcggccgctctagaactagtggatcccccgggctgcaggaattcgcacgagaccattacctagaacatcctaatcgaaaaagcgccacctgctagggtcaacacccgctctctgcggactgcgtgagcgtgaagcaccagcggcggccaccgggcaggacgagccccctccccaaacagagagggccggggatcagtgcgtgcgctcctggtggagggcgtggaagagcttggcaggcggcaagcaggggtttgggaagatggtttcgctctcgacttggttccgctatgccgcacaaaagttcgagtactgcgtttccctctcngtgaagaatataatgatggtggccggatcagcagcacgcagctaactgatgtngtgaacaaaattnatccnagggcagctcaactacgtgtgtccgaccaaaggggaagaangccatggctcccatcggatcttcaaactgaaggagccgtc

SEQ ID NO: 38559 - protein, 36 aa, Zea mays
  misc_feature: Ceres CLONE 1427161-F
MVSLSTWFRYAAQKFEYCVSLSVKNIMMVAGSAARS

SEQ ID NO: 38560 - DNA, 568 bp, Zea mays
  misc_feature: Ceres CLONE 1427182-F
  misc_feature (358)..(358): n is a, c, t, g, unknown, or other
aagctggagctccccgcggtggcggccgctctagaactagtggatcccccgggctgcaggaattcgcacgagaccattacctagaacatcctaatcgaagaattcactcctccctctgcctgtattcttcgtttcgcccctgggatcctcgtcacgactcaggccatccgcccccaccgccaccaccagccacaccatctctgttctccagtcacgccagacggccagaacccacaattttcatcacaccaaaccatccactcctcacctttccccccaaacaagtccaatctttacgacgacattgtcgccaactacaaccactttcccttcgtggggtgcctcacccgattacccnacttaaaaatccccaggtttcccaaatctaaaaaacggggggccttttccccaaagggttttccccgggaaaccaattttgggcgcccaatcctttccaaaaaccccccaaattttttttgggccccctttttcgagcccaaacctttaaaaaattttttttctcccccgggaaaaaccaaggggggcccccaaatttccctccggggaa

SEQ ID NO: 38561 - DNA, 617 bp, Zea mays
  misc_feature: Ceres CLONE 1427185-F
  misc_feature: Encodes the peptide sequence at SEQ ID NO. 38562
  misc_feature (342)..(342): n is a, c, t, g, unknown, or other
  misc_feature (355)..(355): n is a, c, t, g, unknown, or other
aaactggagctccccgcggtggcggccgctctagaactagtggatcccccgggctgcaggaattcgcacgagaccattacctagaacatcctaatcgaaaaatctcccataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacnactagcgcttgcngcgagcgccttaccacaaccaattggccaattgcaaccacaatccttggcacatctaaacctaccaaacattggaacgcaacacacaccacaacagtttctgccatcactgaaccacctagccgtgggtgaccctgtcaactacttgcaacagcagctgcttgcatccaacccacttgctctggcaaacgtagctgcataacagcaaacaacacagctgcaacagtttaagccagtgctccatcaacctagcatggttgacc

SEQ ID NO: 38562 - protein, 128 aa, Zea mays
  misc_feature: Ceres CLONE 1427185-F
  misc_feature (1)..(129): Pfam Name: Zein Pfam Description: Zein seed storage protein
  misc_feature (58)..(58): Xaa is any aa, unknown, or other
MATKILALLALLALLVSATNAFIIPQCSLAPSASIPQFLPPVTSMGFEHPAVQAYRLXLALAASALPQPIGQLQPQSLAHLNLPNIGTQHTPQQFLPSLNHLAVGDPVNYLQQQLLASNPLALANVAA

SEQ ID NO: 38563 - DNA, 644 bp, Zea mays
  misc_feature: Ceres CLONE 1427200-F
  misc_feature: Encodes the peptide sequence at SEQ ID NO. 38564
  misc_feature (235)..(235): n is a, c, t, g, unknown, or other
  misc_feature (248)..(248): n is a, c, t, g, unknown, or other
  misc_feature (284)..(284): n is a, c, t, g, unknown, or other
  misc_feature (339)..(339): n is a, c, t, g, unknown, or other
aaagctggagctccccgcggtggcggccgctctagaactagtggatcccccgggctgcaggaattcgcacgagaccattacctagaacatcctaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacnagcggcggctgcngctgccagccaccgccgccggttcatctaccgccgncggtgcatctgccacctccggttcacctggcaccttcgggtgcatctccaaccgncggtccacctgccgccggccggtcacctgccacccgcccgttcatgtgcccgccccccgtttatcttgccgccgccaccatggcacttaccctaattaaacggcccgggctcagacccatccccaggcacacccatgtgcgtgtcaaaagccgcatccaaaccccgtgtcaactggaagggaactcgcggcgttgtggacaccccccatcccggggccatgggtccagatcctgaaggatctatgtacccccgaagggaacaccctattggtctcctcaatgcccattttttcgggaacactggt

SEQ ID NO: 38564 - protein, 57 aa, Zea mays
  misc_feature: Ceres CLONE 1427200-F
MCVSKAASKPRVNWKGTRGVVDTPHPGAMGPDPEGSMYPRREHPIGLLNAHFFGNTG

SEQ ID NO: 38565 - DNA, 678 bp, Zea mays
  misc_feature: Ceres CLONE 1427205-F
  misc_feature: Encodes the peptide sequence at SEQ ID NO. 38566
  misc_feature (420)..(420): n is a, c, t, g, unknown, or other
  misc_feature (421)..(421): n is a, c, t, g, unknown, or other
  misc_feature (426)..(426): n is a, c, t, g, unknown, or other
  misc_feature (436)..(436): n is a, c, t, g, unknown, or other
  misc_feature (443)..(443): n is a, c, t, g, unknown, or other
  misc_feature (450)..(450): n is a, c, t, g, unknown, or other
  misc_feature (451)..(451): n is a, c, t, g, unknown, or other
  misc_feature (453)..(453): n is a, c, t, g, unknown, or other
  misc_feature (460)..(460): n is a, c, t, g, unknown, or other
  misc_feature (468)..(468): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (492)..(492): n is a, c, t, g, unknown, or other
  misc_feature (496)..(496): n is a, c, t, g, unknown, or other
  misc_feature (498)..(498): n is a, c, t, g, unknown, or other
  misc_feature (499)..(499): n is a, c, t, g, unknown, or other
  misc_feature (516)..(516): n is a, c, t, g, unknown, or other
  misc_feature (524)..(524): n is a, c, t, g, unknown, or other
  misc_feature (527)..(527): n is a, c, t, g, unknown, or other
  misc_feature (530)..(530): n is a, c, t, g, unknown, or other
  misc_feature (532)..(532): n is a, c, t, g, unknown, or other
  misc_feature (568)..(568): n is a, c, t, g, unknown, or other
  misc_feature (571)..(571): n is a, c, t, g, unknown, or other
  misc_feature (600)..(600): n is a, c, t, g, unknown, or other
  misc_feature (639)..(639): n is a, c, t, g, unknown, or other
  misc_feature (660)..(660): n is a, c, t, g, unknown, or other
tagctggagctccccgcggtggcggccgctctagaactagtggatcccccgggctgcaggaattcgcacgagaccattacctagaacatcctaatcgaaaaatcgcccccgtctgcttctttccatccgccccgagaggagcttctactaacgtgagacccctgcggtatccttggtggaggaaaaggagtctacgtcgatcccgctcaaccagggggcggaggctgtctacccggaggatgcggccaagtcgccgccgcgacccagctcgcccaccacctccgcacgcacgtcccgtgtgtgcgaaagttggaatcgacatatttggtcgggggttttggactggtctgggattcatatttctgggtggtatggttgtgtcttcctgggttggttgaatgtttttgtgtgtgccccccnncccanaagaaatccngggggangaccgcnncntcggccncgacgccnggactcccgcaattnnngggggtngtgntnncactggtgccagagacntcgcgatngtncgncnttcggcgaatctgggggttctgaatggtggagtcgntancctcgatcgtgggccccattcctcccttncccaatggagaattgacgttcctttgtcgcgagaggcgnttgggacacacttaccacagncagtgctcgtatccactc

SEQ ID NO: 38566 - protein, 52 aa, Zea mays
  misc_feature: Ceres CLONE 1427205-F
MRPSRRRDPARPPPPHARPVCAKVGIDIFGRGFWTGLGFIFLGGMVVSSWVG

SEQ ID NO: 38567 - DNA, 776 bp, Zea mays
  misc_feature: Ceres CLONE 1427214-F
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (395)..(395): n is a, c, t, g, unknown, or other
  misc_feature (406)..(406): n is a, c, t, g, unknown, or other
  misc_feature (409)..(409): n is a, c, t, g, unknown, or other
  misc_feature (447)..(447): n is a, c, t, g, unknown, or other
  misc_feature (456)..(456): n is a, c, t, g, unknown, or other
  misc_feature (484)..(484): n is a, c, t, g, unknown, or other
  misc_feature (489)..(489): n is a, c, t, g, unknown, or other
  misc_feature (491)..(491): n is a, c, t, g, unknown, or other
  misc_feature (534)..(534): n is a, c, t, g, unknown, or other
  misc_feature (538)..(538): n is a, c, t, g, unknown, or other
  misc_feature (553)..(553): n is a, c, t, g, unknown, or other
  misc_feature (570)..(570): n is a, c, t, g, unknown, or other
  misc_feature (573)..(573): n is a, c, t, g, unknown, or other
  misc_feature (588)..(588): n is a, c, t, g, unknown, or other
  misc_feature (589)..(589): n is a, c, t, g, unknown, or other
  misc_feature (591)..(591): n is a, c, t, g, unknown, or other
  misc_feature (594)..(594): n is a, c, t, g, unknown, or other
  misc_feature (610)..(610): n is a, c, t, g, unknown, or other
  misc_feature (665)..(665): n is a, c, t, g, unknown, or other
  misc_feature (693)..(693): n is a, c, t, g, unknown, or other
  misc_feature (757)..(757): n is a, c, t, g, unknown, or other
gggggggggcccccccaccccccctaacaggggtttnnnnnnnnnnttntnnnnaaaaggtgggactccccgcggtggcggccgctctagaactagtggatcccccgggctgcaggaattcgcacgagaccattacctagaacatcctaatcgaaaaatcttgtcttcgggaccctctcatctcatgcccaaagattccgcttagcttccgattagcttcaaaagagggtgctggtggggccatccaagtcgaacgcttagttcaagaggtcccaagtctagttctggagagggagagatgggaagactgagtattgaggaaggatccgtgttatcctccctttcgtgatcgggtatgacacagccaagtacccttttcagctcctgtttttccnttaagaaattnttntaaaaaaggtgttgtggggggggggggggggggttggnggggggttntggatttccttggtggggtgcccccccntcggntnatgttatggattttagaagttgttgtggttttttaatgcaggnggcntaccatctgagtcgnttttttttcataaaatnctncgaaaatgggttccnnantanaaatggcgcccctctncagactaccaccaaaaagaactaaaacaggccgggccgccgcggttcacaggcgncccccccccccggcacccgggtcgacantgggagtatgatcgacggccttacttgggggtgaacccctatcaaaggaaggagagacttaagngtatcccctttcgccctgt

SEQ ID NO: 38568 - DNA, 688 bp, Zea mays
  misc_feature: Ceres CLONE 1427222-F
  misc_feature: Encodes the peptide sequence at SEQ ID NO. 38569
  misc_feature (475)..(475): n is a, c, t, g, unknown, or other
  misc_feature (477)..(477): n is a, c, t, g, unknown, or other
  misc_feature (478)..(478): n is a, c, t, g, unknown, or other
  misc_feature (486)..(486): n is a, c, t, g, unknown, or other
aaaagctggagctccccgcggtggcggccgctctagaactagtggatcccccgggctgcaggaattcgcacgagaccattacctagaacatcctaatcgaaaagtattagaaaaagatttgaacatgagtgagcatcatcattttgcgtttgtgcacggtgcagggcatggaggatggtgttggtacaagctcgccaattcactgagagagaatggacataaggccacctgcatcgacctcaagggcgctgggatcaacctaactgatccaaacactgtctcctctcttgatgactacaaccagcctctctatgacttcctctcccaacttcccctcgaccaaaaggtcattctggtgagccacagcgttggaggagggagcatgacggctgccatgtgccagtatccttccaaagtctccatggctgtttacgtcgcagcagccatggtcaaacctggtaccatattccccccnanntctcaagnagtactaaagatatgttcagggatgatagagacggaagctgagaagatatgggacttcacttttggaaaatgacccgaagatctccccaccagtttgatgatgaaacttgatttttccgggaaaagttttacaacgagaccccctgggagattaccacatggttcccaaaatttttggtccagcccgtgtagggcttttgaa

SEQ ID NO: 38569 - protein, 144 aa, Zea mays
  misc_feature: Ceres CLONE 1427222-F
  misc_feature: SWISSPROT Homolog: EC 3.1.1.78 Polyneuridine-aldehyde esterase
  misc_feature (118)..(118): Xaa is any aa, unknown, or other
  misc_feature (121)..(121): Xaa is any aa, unknown, or other
MSEHHHFAFVHGAGHGGWCWYKLANSLRENGHKATCIDLKGAGINLTDPNTVSSLDDYNQPLYDFLSQLPLDQKVILVSHSVGGGSMTAAMCQYPSKVSMAVYVAAAMVKPGTIFPPXSQXVLKICSGMIETEAEKIWDFTFGK

SEQ ID NO: 38570 - DNA, 674 bp, Zea mays
  misc_feature: Ceres CLONE 1427240-F
  misc_feature: Encodes the peptide sequence at SEQ ID NO. 38571
aaagctggagctccccgcggtggcggccgctctagaactagtggatcccccgggctgcaggaattcgcacgagaccattacctagaacatcctaatcgaaaaatctatcgcactcgtagtcatagctcaagcatcagcggcaggagctctgggcagcgtgcgcacgtggggtacctagctcgctctgctagcctaccatggctgatcaccaccggggtgcgacgggaggtggcgggggctaccgcgacctccagcgcgggggcggcatgcacggcgaggcgcagcaggcagcagaagcacggcgccatgatgacggcgctcaaggccgcgacagccgccaccttcggcgggtcgatgctggtgctgtccgggctgatcctggccggcaccgtgatcacactcaccgtggccacccccgtgctggtgatcttcagcccggtgctggtgccggccgccatcgcactggcgctcatggcgaccgggttcgtcacctccggcggcctctgcgacgctgcgctgtccgtgttctcctggatgtacaagtacctgacgggcaagcacccgccgggcgccgaccatctggaccacgccaaggcgaggctggcgtccaacgcccgcgacatcaaggatgcatcacagcaccgcatcgaccatgtgcaggggtcttgagagaa

SEQ ID NO: 38571 - protein, 120 aa, Zea mays
  misc_feature: Ceres CLONE 1427240-F
  misc_feature (1)..(113): Pfam Name: Oleosin Pfam Description: Oleosin
MMTALKAATAATFGGSMLVLSGLILAGTVITLTVATPVLVIFSPVLVPAAIALALMATGFVTSGGLCDAALSVFSWMYKYLTGKHPPGADHLDHAKARLASNARDIKDASQHRIDHVQGS

SEQ ID NO: 38572 - DNA, 664 bp, Zea mays
  misc_feature: Ceres CLONE 1427242-F
  misc_feature: Encodes the peptide sequence at SEQ ID NO. 38573
  misc_feature (343)..(343): n is a, c, t, g, unknown, or other
tcccccgggctgcaggaattcgcacgagaccattacctagaacatcctaatcgaaaaatcaaactccttaggtatgccaacaccgggtggatgaatgacagacacgcccacccacccatctcaggaagccaggggctatgcagcaacagatgcccatgccgccagcgcccgctgccgccgcggtggcggtgccccccgacgacggcatcactaccgagcagatccacaactatttcgacgaaaataagcaatttactttggacatcctcgaaaatcagaactcaccgaagtcgactgaatgcgctcactagaaagctggcattcgaaataacctcttgtaacnaccccgcgatttctgatgcccaaaccctgcctccgcagaaccctggctgtcgacctcagatgatccccccctgtaaagtgcttggtgcagcggtgtccatggcacaagtagcaatggtggctgcaagaacggcccttgcttcccagggacatggtgggatcagaggtcatgacaacggttctgccccggggggaggcgggaggagggaggctcgctacatcttcctggcaaaaatcgtcgttggggggccgggcccccataccacgggggtgggaagccgcccaacgggccttctgcccgggcgtgaaagctggctcccgg

SEQ ID NO: 38573 - protein, 57 aa, Zea mays
  misc_feature: Ceres CLONE 1427242-F
MQQQMPMPPAPAAAAVAVPPDDGITTEQIHNYFDENKQFTLDILENQNSPKSTECAH

SEQ ID NO: 38574 - DNA, 676 bp, Zea mays
  misc_feature: Ceres CLONE 1427245-F
  misc_feature: Encodes the peptide sequence at SEQ ID NO. 38575
aagctggagctccccgcggtggcggccgctctagaactagtggatcccccgggctgcaggaattcgcacgagaccattacctagaacatcctaatcgaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaaggacaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgaccctggtgggcaagcgacgccgacggcagtgatggcagatgacaagaaagcaggcggcggcgacgacgacaagaagaagagccgtgtaaatc

SEQ ID NO: 38575 - protein, 163 aa, Zea mays
  misc_feature: Ceres CLONE 1427245-F
MAMGAASILLMMVSLEALLLAAAAGGGTIRLPSDVGGVAADLVTAMARARARTKHQLRDEERPWGECCDLAVCVKTYPLTCSCFDRVERCSDACKECVETEDSRHVCVDRYRGDPGPRCHDEDGRSGGPADDDPGGQATPTAVMADDKKAGGGDDDKKKSRVN

SEQ ID NO: 38576 - DNA, 645 bp, Zea mays
  misc_feature: Ceres CLONE 1427250-F
  misc_feature: Encodes the peptide sequence at SEQ ID NO. 38577
  misc_feature (584)..(584): n is a, c, t, g, unknown, or other
tggagctccccgcggtggcggccgctctagaactagtggatcccccgggctgcaggaattcgcacgagaccattacctagaacatcctaatcgaaaactcttggcctcaatccctgaagtgcctgccaccacgccgcgccgcgccgcgcccgccatacaacgacttcctgcagtcctgcgctgcgcccctcctttccgcctccacgctgccgacgtccaccacacagcacggtcgactcacccgatccctccatggcggcggcggtggcggtcgcggctgccacgacggcggaggacgaggcgcgcctgctgcgtctggaggagcaggcggagcacggcggcggcggcgcctgggactacctctgcctcgcccgccggctccgcgcccgccgccccgcccacgtcctccgcgtcggcctcgctctcctcaacaacgcctccgctcgctccggtctcgcctcagaacagtggacgctctacgagcaggtggccacggcggccatggattgccagcgtctcgatgtggcaaaggactgtattggagtcctttcaaagcaatttcctggcagcacccgggttgcccnggctagaaactcctcttgttgaaacgaaaaggaatgggctgaaacttaaaaagcctaaccc

SEQ ID NO: 38577 - protein, 117 aa, Zea mays
  misc_feature: Ceres CLONE 1427250-F
  misc_feature (111)..(111): Xaa is any aa, unknown, or other
MAAAVAVAAATTAEDEARLLRLEEQAEHGGGGAWDYLCLARRLRARRPAHVLRVGLALLNNASARSGLASEQWTLYEQVATAAMDCQRLDVAKDCIGVLSKQFPGSTRVAXARNSSC

SEQ ID NO: 38578 - DNA, 676 bp, Zea mays
  misc_feature: Ceres CLONE 1427251-F
  misc_feature: Encodes the peptide sequence at SEQ ID NO. 38579
ctggagctccccgcggtggcggccgctctagaactagtggatcccccgggctgcaggaattcgcacgagaccattacctagaacatcctaatcgaaaagtattagaaaaagatttgaacatgagtgagcatcatcattttgcgtttgtgcacggtgcagggcatggaggatggtgttggtacaagctcgccaattcactgagagagaatggacataaggccacctgcatcgacctcaagggcgctgggatcaacctaactgatccaaacactgtctcctctcttgatgactacaaccagcctctctatgacttcctctcccaacttcccctcgaccaaaaggtcattctggtgagccacagcgttggaggagggagcatgacggctgccatgtgccagtatccttccaaagtctccatggctgtttacgtcgcagcagccatggtcaaacctggtaccataattcccccaattctcaaggaagtactaaagatatgttcagggatgatagagacggaagctgagaagatatgggacttcacttttggaaatggacccgagaatctccccacaagtatgatgatgaaacctgagtatgtccgggacaagtattacaacgagagccccatggaggttaattatcttttattaccaaactctttattatgaactttgct

SEQ ID NO: 38579 - protein, 182 aa, Zea mays
  misc_feature: Ceres CLONE 1427251-F
  misc_feature: SWISSPROT Homolog: EC 3.1.1.78 Polyneuridine-aldehyde esterase
MSEHHHFAFVHGAGHGGWCWYKLANSLRENGHKATCIDLKGAGINLTDPNTVSSLDDYNQPLYDFLSQLPLDQKVILVSHSVGGGSMTAAMCQYPSKVSMAVYVAAAMVKPGTIIPPILKEVLKICSGMIETEAEKIWDFTFGNGPENLPTSMMMKPEYVRDKYYNESPMEVNYLLLPNSLL

SEQ ID NO: 38580 - DNA, 587 bp, Zea mays
  misc_feature: Ceres CLONE 1427257-F
  misc_feature: Encodes the peptide sequence at SEQ ID NO. 38581
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (390)..(390): n is a, c, t, g, unknown, or other
  misc_feature (394)..(394): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggactccaccgcggtggcggccgctctagaatagtggatcccccgggctgcaggaattcccgagaccattacctagaacatcctaatcgaaaaaattattgagaccaactagcaacatagaaagcaaatagtgtaccacaatggcagccaaaaattttgcctcctatgcccttggtcttctgcaagtgctgctcggcgacatttttccgcatgctcgcagctctatagcttccttctttcccgtactctcacagcggtgtcttcggtatgtgaaaccccattctcaccntaangatcaacaggcatcgcagctggcatcttactttatcaccctgttccttcaaaatcatcagccctattacaacagttacttttggggcatttattggcccaaacatcgggcccaacaactacacaacttggggaatcaaaactttgttgccaaatcttaaaaaaagaattttttccatttcacccacataggtt

SEQ ID NO: 38581 - protein, 13 aa, Zea mays
  misc_feature: Ceres CLONE 1427257-F
PKLDSTAVAAALE

SEQ ID NO: 38582 - DNA, 620 bp, Zea mays
  misc_feature: Ceres CLONE 1427261-F
  misc_feature: Encodes the peptide sequence at SEQ ID NO. 38583
  misc_feature (1)..(1): n is a, c, t, g, unknown, or other
  misc_feature (373)..(373): n is a, c, t, g, unknown, or other
naaagctggagctccccgcggtggcggccgctctagaactagtggatcccccgggctgcaggaattcgcacgagaccattacctagaacatcctaatcgaaaagcatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactggtggccctcacgcttcagccgtgccagatgccnatgatgatgccaggtatgatgccaccgatgacaatgatgccgatgccgatatgatgccctcgatgatggtgccaatatgatgtccccataacgatagctagtatgatgccaccgatgatgatgcccaacatggtttcaccaatgatgatgcccagtatgatggcctctaccatgaacccccagaatgatacccccccataagggtcgccagtatgataccacccgattataaaccccaacatggggt

SEQ ID NO: 38583 - protein, 93 aa, Zea mays
  misc_feature: Ceres CLONE 1427261-F
MAAKMFALFALLALCATATSATHIPGHLSPLLMPLATMNPWMQYCMKQQGVANLLAWPTLMLQQLVALTLQPCQMPMMMPGMMPPMTMMPMPI

SEQ ID NO: 38584 - DNA, 635 bp, Zea mays
  misc_feature: Ceres CLONE 1427264-F
  misc_feature: Encodes the peptide sequence at SEQ ID NO. 38585
  misc_feature (381)..(381): n is a, c, t, g, unknown, or other
aaagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcatcacttacagcaaaggcggatgtaccatcgagcacgtccgacggccatgaggtcttgctgtttgaagctcttcgtgaggccttgatgcaagagatgcaattagatccnacagtgtgtgtatttggtgaggatgattgccattaccgtggcttcttacaaagtgacaaaaaggtttggcttgatacgtttggagaccttccaagtctggacaacccctattgcggaaaaactcctttactggcctggggaattggagcgggaaatgaaaagccttgaagcccctccttgaaggcatgaacatggggatccctggtccctggctttacacccgaatctccaaataaaggtggggatgctttact

SEQ ID NO: 38585 - protein, 136 aa, Zea mays
  misc_feature: Ceres CLONE 1427264-F
  misc_feature: SWISSPROT Homolog: EC 1.2.4.1 Pyruvate dehydrogenase (acetyl-transferring)
MATAFSLRAAAPATAPRAVSRSTSAARVVPVASALAGRGRLVARASLTAKADVPSSTSDGHEVLLFEALREALMQEMQLDPTVCVFGEDDCHYRGFLQSDKKVWLDTFGDLPSLDNPYCGKTPLLAWGIGAGNEKP

SEQ ID NO: 38586 - DNA, 667 bp, Zea mays
  misc_feature: Ceres CLONE 1427271-F
  misc_feature: Encodes the peptide sequence at SEQ ID NO. 38587
aaagctggagctccccgcggtggcggccgctctagaactagtggatcccccgggctgcaggaattcgcacgagaccattacctagaacatcctaatcgaaaaattccgtcgtcgtcatcagcagcttctgcttgctctgggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggcgaaggacgaggtgttctgcctgttcgagggggtgctggacaacctgtgtcgtctgagccagcagcacgggctgtcaagcatgggcgccaacgaggtgctcctcgtcatcgaggcctacaagaggctgcgcgaccgcacgccctacccggccagcttcatgctcggccagctcatcggctcctacgccttcgtcctcttcgacagtccaccatctccctgctcgtcgcatccgaccgcgatgt

SEQ ID NO: 38587 - protein, 152 aa, Zea mays
  misc_feature: Ceres CLONE 1427271-F
MLAVFSGQVVEVPAELVAAGSRTPSPKTKASQLVGRFLAASEPAVSVQLGDHGHLAYSHTNQALLRPRSFAAKDEVFCLFEGVLDNLCRLSQQHGLSSMGANEVLLVIEAYKRLRDRTPYPASFMLGQLIGSYAFVLFDSPPSPCSSHPTAM

SEQ ID NO: 38588 - DNA, 621 bp, Zea mays
  misc_feature: Ceres CLONE 1427287-F
  misc_feature (212)..(212): n is a, c, t, g, unknown, or other
  misc_feature (213)..(213): n is a, c, t, g, unknown, or other
aaagctggagctcaccgcggtggcggccgctctagaatagtggatcccccgggctgcaggaattcgcacgagaccattacctagaacatcctaatcgaaaaactcgccgcctcctccccactgcctcgtgtggccgtcgtctcccgttcggaacgccaagccccccctccggcgaaatggcccccaagcgaggtggcagggcgccggtgccnngccagaagaagacagattaagtgacgaaacctctatttccagagaaggcgaaagcagtcggcattcggcggggcggttgcggcccaggaaaggacttgcacgggttcctctagttgcgccaaggtctggtgtatacagagggaaggccccattctcaaagaggggccccaaggggcccccggggttaaacagtttttacgccacctccacaaaaaaccccctaccaaactgttgataaaggttttccaagaacggcccgaagaaaaagggtgtccaaaaaggagaaggttctttaaaagggccccccttgataattaaggaaaaaacgttttgtttcaaaaaaacaattgtttgggggaaatgggccgttaccccaggggggtttcctcccttggaggaaaaaaaaga

SEQ ID NO: 38589 - DNA, 686 bp, Zea mays
  misc_feature: Ceres CLONE 1427302-F
  misc_feature: Encodes the peptide sequence at SEQ ID NO. 38590
  misc_feature (472)..(472): n is a, c, t, g, unknown, or other
  misc_feature (473)..(473): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcgaaaaatcacactcgccaaccccgtcatcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaaggaggttgctgtgtttggctgcaggaaccctgaggagatccccgtgggttcggttggtgctgaatatnngtgtgagtctactggtggtttcactgacccagagaaggctgcagctcacttgaaggntgtgccaagaaaggtgtcatctctgctctagcaaggatgcccccatgtttgtccttggggcaacaaaaagagtacaagtctgacataaaattggctccaatgctaggtgaaaaccaaaggtttggccccttgtgaagggaataaaggaaagttcga

SEQ ID NO: 38590 - protein, 125 aa, Zea mays
  misc_feature: Ceres CLONE 1427302-F
  misc_feature (4)..(120): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (97)..(97): Xaa is any aa, unknown, or other
  misc_feature (116)..(116): Xaa is any aa, unknown, or other
MAKIKIGINGFGRIGRLVARVALQSDDVELVAVNDPFISTDYMTYMFKYDTVHGQWKHHEVKVKDSKTLLFGEKEVAVFGCRNPEEIPVGSVGAEYXCESTGGFTDPEKAAAHLKXVPRKVSSLL

SEQ ID NO: 38591 - DNA, 670 bp, Zea mays
  misc_feature: Ceres CLONE 1427305-F
  misc_feature: Encodes the peptide sequence at SEQ ID NO. 38592
  misc_feature (657)..(657): n is a, c, t, g, unknown, or other
aagctggagctccccgcggtggcggccgctctagaactagtggatcccccgggctgcaggaattcgcacgagaccattacctagaacatcctaatcgaaaaatgggtaattcctcgctcccggattcagcgtcgggtttctctctctctctctacaattatcactacctgctgctccctcatgcaccgtgctcaaatctgaccaaagtgggttctgctgactgttttttgtgtttttttggggtctctcgatcttctctggatgcaggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagacgcacccnatgtttgttgttg

SEQ ID NO: 38592 - protein, 189 aa, Zea mays
  misc_feature: Ceres CLONE 1427305-F
  misc_feature (58)..(188): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (186)..(186): Xaa is any aa, unknown, or other
MGNSSLPDSASGFSLSLYNYHYLLLPHAPCSNLTKVGSADCFLCFFGVSRSSLDAGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPXVCC

SEQ ID NO: 38593 - DNA, 663 bp, Zea mays
  misc_feature: Ceres CLONE 1427321-F
  misc_feature (447)..(447): n is a, c, t, g, unknown, or other
  misc_feature (483)..(483): n is a, c, t, g, unknown, or other
  misc_feature (572)..(572): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
tggagctccccgcggtggcggccgctctagaactagtggatcccccgggctgcaggaattcgcacgagaccattacctagaacatcctaatcgaaaactgttgacaaggtaacaggaggttctgcaaatttcgaggatcctctttgtgaggcatcgaggaaggaacctgacattgagaagagtcacccaagcctcggagaagaggaagacgatacaataggtggaacagtcttccctggttcaggtagctgtgaattatcatgtccacaggatggtggcatcgcagtctacgaggggcctgagatggtgtcaccagagagccaaactgatgctcggaaagaaaacatccattcagatgtcgctgagacagatgaatgcaccaagactcagaaggccgctctagcaggcacagagggagaaaattctgctgaagattctggtgtgccngtgtctgagatgggacaatgcaacgagatgcccaangatgcttcgacacttacagcaacaggtgcaaatcctgctgaagaacgagcttccctgaaagaactctctgtgccaaccgaagaacagantttcttctgcctcccagcttcctgaatatccgcaagggcaccaacaaaaaaacacttggcattgcannnnnnnnnnnnnnnnnnnnnnnnn

SEQ ID NO: 38594 - DNA, 685 bp, Zea mays
  misc_feature: Ceres CLONE 1427322-F
  misc_feature: Encodes the peptide sequence at SEQ ID NO. 38595
  misc_feature (385)..(385): n is a, c, t, g, unknown, or other
  misc_feature (450)..(450): n is a, c, t, g, unknown, or other
  misc_feature (519)..(519): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgcntgtgctgtcggggctggcgctgacggcctccgtggtggggctggccgtggccacgccggtgtccntgaatctcagccccgtgctggtccccgccgccctgctcatcgggacgggcgtcatgggggtccttcacntcgggcccccttgggcctcgggggcctgtcctccttcacttggcttgccaaaacgggggcgggagggggttccacccacccccgaatacctgggaaaagcccccccccaagattggggaggcccccggcccaccggggccacaaaacccccagggggggcccagcc

SEQ ID NO: 38595 - protein, 161 aa, Zea mays
  misc_feature: Ceres CLONE 1427322-F
  misc_feature (44)..(155): Pfam Name: Oleosin Pfam Description: Oleosin
  misc_feature (62)..(62): Xaa is any aa, unknown, or other
  misc_feature (84)..(84): Xaa is any aa, unknown, or other
  misc_feature (107)..(107): Xaa is any aa, unknown, or other
MADRDRSGIYGGAHATYGQQQQQGGGGRPMGEQVKGMLHDKGPTASQALTVATLFPLGGLLXVLSGLALTASVVGLAVATPVSXNLSPVLVPAALLIGTGVMGVLHXGPPWASGACPPSLGLPKRGREGVPPTPEYLGKAPPQDWGGPRPTGATKPPGGAQ

SEQ ID NO: 38596 - DNA, 665 bp, Zea mays
  misc_feature: Ceres CLONE 1427325-F
  misc_feature: Encodes the peptide sequence at SEQ ID NO. 38597
aagctggagctccccgcggtggcggccgctctagaactagtggatcccccgggctgcaggaattcgcacgagaccattacctagaacatcctaatcgaaaaatgggtaattcctcgctcccggattcagcgtcgggtttctctctctctctctacaattatcactacctgctgctccctcatgcaccgtgctcaaatctgaccaaagtgggttctgctgactgttttttgtgtttttttggggtctctcgatcttctctggatgcaggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagacgcacccatgtttgtt

SEQ ID NO: 38597 - protein, 188 aa, Zea mays
  misc_feature: Ceres CLONE 1427325-F
  misc_feature (58)..(188): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGNSSLPDSASGFSLSLYNYHYLLLPHAPCSNLTKVGSADCFLCFFGVSRSSLDAGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFV

SEQ ID NO: 38598 - DNA, 664 bp, Zea mays
  misc_feature: Ceres CLONE 1427339-F
  misc_feature: Translation starting site: 188
  misc_feature (396)..(396): n is a, c, t, g, unknown, or other
ctggagctccccgcggtggcggccgctctagaactagtggatcccccgggctgcaggaattcgcacgagaccattacctagaacatcctaatcgaaaactctagccaaaaccctagcagccgcccggtgctccctctctgcagatctcccttcgcagccgccgaggaaccccttcacagcgcggaagatggctgaacaggaggccccagtcgcggttgaggcaccaaccccagttcttggggagcctatggacttgatgactgctctgcagctcgtgatgaagaatcaagtgctcatgacggtcttgtgaaggtctccgtgaggctgccaggccatcgagaagcacgcgctcagctttgcgtgcttgctgaggactgtgaccagccagattacgtncagttgggtgaaggcactctgcgctgagcacaatgtccacctggtcactgtccctgccgctaagactctttgccaggggggccgggcttggcaagattgactcttaaggcaagccagggaaggttgaagctgctccctggtcgtcctcagggactacgggaaaaaaccgaagggcttaaccttgggcaggagtttgtcaagccccccaaaggggtgaagggtttccggaaccctttggtttggaccggggctaaaaattagcttttgt

SEQ ID NO: 38599 - DNA, 658 bp, Zea mays
  misc_feature: Ceres CLONE 1427350-F
  misc_feature: Encodes the peptide sequence at SEQ ID NO. 38600
aaagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctcctctgcctcgaggagttccgcgccctgctcttcggctccggggactcgcccgctgctcggcccccgctcgaccgcctcgtcgccgacttctccgaccgcgccgtcaaggcgctcgacctctgcaacgccgtccgcgacg

SEQ ID NO: 38600 - protein, 126 aa, Zea mays
  misc_feature: Ceres CLONE 1427350-F
MPATDSSSSSSSSPAAAPLSSIGRSIRSLRRDQNQIHSFPPPPDATDAFQRRAAQLLADLPAADDVLSLAWTRRLLESFLLCLEEFRALLFGSGDSPAARPPLDRLVADFSDRAVKALDLCNAVRD

SEQ ID NO: 38601 - DNA, 729 bp, Zea mays
  misc_feature: Ceres CLONE 1427357-F
  misc_feature: Encodes the peptide sequence at SEQ ID NO. 38602
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (417)..(417): n is a, c, t, g, unknown, or other
  misc_feature (432)..(432): n is a, c, t, g, unknown, or other
  misc_feature (510)..(510): n is a, c, t, g, unknown, or other
  misc_feature (511)..(511): n is a, c, t, g, unknown, or other
  misc_feature (519)..(519): n is a, c, t, g, unknown, or other
  misc_feature (540)..(540): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaaactgggactccaccgcggtggcggccgctctagactagtggatcccccgggctgcaggaattcgcacgagaccattacctagaacatcctaatcgaaaaatatcgcacatattattgagaccaactagcaacatagaaagcacaatagtgtaccaacaatggcagccaaaatattttgcctccttatgctcctttggtcttctgcaagtgctgctacngcgaccattttcccngcatgctcgcaagctcctatagcttccctttctccccccgtactctcatcagcggtgtcttcggtatgtgaaaacccnnatcttcanccctacaggatccaccaggcnatcgcagctgggatctttacttttatccacccttgtttctcccaaaaattcatcagcccttataacaaaaagttaacctttgggggcatttttttgggcacaaaaaaatttgggggccacacaccttcaaaaaaaactttgggtaaaaaaaaaccttgggggcgccaaccccccagaaaaaaaaaggtt

SEQ ID NO: 38602 - protein, 124 aa, Zea mays
  misc_feature: Ceres CLONE 1427357-F
  misc_feature (52)..(52): Xaa is any aa, unknown, or other
  misc_feature (54)..(54): Xaa is any aa, unknown, or other
MAAKIFCLLMLLWSSASAATATIFPACSQAPIASLSPPVLSSAVSSVCENPXLXPYRIHQAIAAGIFTFIHPCFSQKFISPYNKKLTFGGIFLGTKKFGGHTPSKKTLGKKKPWGRQPPRKKKV

SEQ ID NO: 38603 - DNA, 723 bp, Zea mays
  misc_feature: Ceres CLONE 1427361-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (494)..(494): n is a, c, t, g, unknown, or other
  misc_feature (495)..(495): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccaccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaaagggcgtggcaagaatcanngagaaagatagcagggggggctagcttagcttgagctcgtgcgacgaaaaaatggcccgaaattgggcaggaaacttggtggcccccccccttcctgggggctccaccccccacatcatggtgaaataaaccggaaaattgggggtttcccggaagttgggaaaccctgaaaaccccttttttattcaaaagggggggaaaaacaaaaaaatattcccccccgggggc

SEQ ID NO: 38604 - DNA, 595 bp, Zea mays
  misc_feature: Ceres CLONE 1427366-F
  misc_feature: Encodes the peptide sequence at SEQ ID NO. 38605
  misc_feature (243)..(243): n is a, c, t, g, unknown, or other
  misc_feature (303)..(303): n is a, c, t, g, unknown, or other
aaagctggagctccccgcggtggcggccgctctagaactagtggatcccccgggctgcaggaattcgcacgagaccattacctagaacatcctaatcgaaaaacttttcaaatcgacaaaggggaaaggttcgcttcttctcgcatcttgctttacttcgagtgccatggccgatccggcggaggaagacgttgtctcgccgccaccgacccctgcggccccagccgtgggcgcctcagactncgccctgcagcctgttgctgacggcgcctcaaccgaaaggtgtcttgccccgcgcccgangtaaagtcccgggggattcaagcttccttgaagagggaaccttccctggcccaatcccttgggggccggtaaactgctgacgttcttttatggaagacaaaaaaaaactttgcctttttaaaagggggccaactttatcttgggtctgttcccaagggcttaatacccccccccggcccccaaatcccccgggcgggttgggggggtttcccccctttttctgggggccaaaaaaccccctttttttataaaaaaccccccccgaattttcccccaaggcggggttttttag

SEQ ID NO: 38605 - protein, 45 aa, Zea mays
  misc_feature: Ceres CLONE 1427366-F
  misc_feature (26)..(26): Xaa is any aa, unknown, or other
MADPAEEDVVSPPPTPAAPAVGASDXALQPVADGASTERCLAPRP

SEQ ID NO: 38606 - DNA, 673 bp, Zea mays
  misc_feature: Ceres CLONE 1427389-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (155)..(155): n is a, c, t, g, unknown, or other
  misc_feature (156)..(156): n is a, c, t, g, unknown, or other
  misc_feature (166)..(166): n is a, c, t, g, unknown, or other
  misc_feature (189)..(189): n is a, c, t, g, unknown, or other
  misc_feature (201)..(201): n is a, c, t, g, unknown, or other
  misc_feature (348)..(348): n is a, c, t, g, unknown, or other
  misc_feature (357)..(357): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttnnnnnnnnnccaaagctggggactccaccccggnntggcggccgnctctagaactagtgggatccccncgggctgcaggnaattcgcacgaagaaccattacctagaacatcctaatcgaaaaattcaccttggctgcagcctgcaacacaatcctacgcttccgacttcaacgcgcgcccctcccattttcactagccctactcctttgacataaaggaagatggnagcatatgncacgactggtatgcagatgatagcaacacgccctttcattccgggctacagggaaataacttgggtcgacatcaggcacttatcttgcattttggaaagggcaaatctggtttccaaaaaatgggcttttgccaatttctcttccaaaggcccccttcggccgggagcccccgggggttttcttccaaaattcaaaaaaaaggtttttttttaaggggcaaaattgcccccaaaaaaggggcccccaaagaaattccccctttgttttcccccccgggagaaaaaaaaccttttttttgcggggggggggtgggga

SEQ ID NO: 38607 - DNA, 572 bp, Zea mays
  misc_feature: Ceres CLONE 1427393-F
  misc_feature: Encodes the peptide sequence at SEQ ID NO. 38608
  misc_feature (287)..(287): n is a, c, t, g, unknown, or other
  misc_feature (354)..(354): n is a, c, t, g, unknown, or other
  misc_feature (382)..(382): n is a, c, t, g, unknown, or other
  misc_feature (468)..(468): n is a, c, t, g, unknown, or other
caaagctggagctccccgcggtggcggccgctctagaactagtggatcccccgggctgcaggaattcgcacgagaccattacctagaacatcctaatcgaaaagtccgatctctctcccgagtccactccaagccttttcgccttttcctccgccttctcgcgatggcgccgccgcgccgcgctctactcgtcctcgccgctctcctcctctccctctcccttggggccgcctcccttcattccgacgagctcctccctcacgatgacgaagagttcgagggcgtcngtcgccgccccctccgccccctcccggcggggggccccggtggtctcctcctcccgccgcaaatcancggaacgcgccggtgcccgggtcaagcnagtcccacgcagtgcagtttcacgctcgaacacgaaccttggcgacgggcagggcttcgtctcagctgggaacttttctggcccgncttaagaacttcggccacaggcacgcaaacccttaactaaacttccgctttaaaagaaatgatttttccggaggaaggataaacggggggttcaaaaaaagggg

SEQ ID NO: 38608 - protein, 114 aa, Zea mays
  misc_feature: Ceres CLONE 1427393-F
  misc_feature (42)..(42): Xaa is any aa, unknown, or other
  misc_feature (64)..(64): Xaa is any aa, unknown, or other
  misc_feature (102)..(102): Xaa is any aa, unknown, or other
MAPPRRALLVLAALLLSLSLGAASLHSDELLPHDDEEFEGVXRRPLRPLPAGGPGGLLLPPQIXGTRRCPGQASPTQCSFTLEHEPWRRAGLRLSWELFWPXLRTSATGTQTLN

SEQ ID NO: 38609 - DNA, 670 bp, Zea mays
  misc_feature: Ceres CLONE 1427401-F
  misc_feature: Encodes the peptide sequence at SEQ ID NO. 38610
  misc_feature (625)..(625): n is a, c, t, g, unknown, or other
aaaagctggagctcaccgcggtggcggccgctctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacgggcggcgtgcacgacggcaccgccgtcngtgctctgggagtggtgcaagggcgagaaccagagctggaagatc

SEQ ID NO: 38610 - protein, 168 aa, Zea mays
  misc_feature: Ceres CLONE 1427401-F
  misc_feature (154)..(154): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGRRARRHRRXCSGSGARARTRAGR

SEQ ID NO: 38611 - DNA, 707 bp, Zea mays
  misc_feature: Ceres CLONE 1427406-F
  misc_feature: Translation starting site: 359
  misc_feature (160)..(160): n is a, c, t, g, unknown, or other
  misc_feature (396)..(396): n is a, c, t, g, unknown, or other
  misc_feature (412)..(412): n is a, c, t, g, unknown, or other
aagctggagctccccgcggtggcggccgctctagaactagtggatcccccgggctgcaggaattcgcacgagaccattacctagaacatcctaatcgaaaaaggatccattaacacccctacgtacgcctttcctctggaaacccttctctcgcctgccntctcccccgccgcgccgccacttcccctctcccgtcaactccgggcttccgcgcgaggtcgagctagcgtttggagttctcgagacctgctgtgatggcgacagagcaagcggcggagaactacacgggtggaaggaccctcgtggccctgaaccccctacaaccccgacatcctcaacgacctcgagaaagtcgtcaatgagcaggtctcatctcagacatataacttggatgcnaatctcagccttcttncgcttgtaccagtttgagccagaaaggatgagcatacagattgggggcccacatactgattaaaggctccttatggaaatgccaaccccctgaacttcaggtgggggctaattcttaatccctgaaacctgggcaaatggaaggaaccatttcaggggattggaaaagtcttttccccccccccaaaaagacgccaaggtcccccccatttttggggaaaaaaaccacaaaaaaccccccccatttcgaaaaaggtggccggtgtttaaaaaaaaaaacccaccctttttgtttt

SEQ ID NO: 38612 - DNA, 656 bp, Zea mays
  misc_feature: Ceres CLONE 1427411-F
  misc_feature: Encodes the peptide sequence at SEQ ID NO. 38613
tggagctccccgcggtggcggccgctctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacgggcggcgtgcacgacggcaccgccgtcgtggctctgggagtggtgcaagggcgagaaccagagct

SEQ ID NO: 38613 - protein, 166 aa, Zea mays
  misc_feature: Ceres CLONE 1427411-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGRRARRHRRRGSGSGARARTRA

SEQ ID NO: 38614 - DNA, 678 bp, Zea mays
  misc_feature: Ceres CLONE 1427421-F
  misc_feature: Encodes the peptide sequence at SEQ ID NO. 38615
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcaacagcaaccacagccatggcaataccccactcaaccaccgcacctaaccccgtgccaacaattcagatcctgccgcgtccgccgcgtcgacaacccgttcctgggccagtgcgtccagttcctgaggcaccagtgcaacccggcggcgacgccctacggctcgccacagtgcctggctctgcagcagaagagctgccaccacatcaggcaggtggagccgctgcaccagtaccacgcgacatacggcgtggacctgcagtccttcctgcaccagcaaccgcagggcgagctcgcggcgctgatggcggctcaggtagcgcaacagctgacagcgatgtgcagcctgcagctgcatcacccaggtn

SEQ ID NO: 38615 - protein, 170 aa, Zea mays
  misc_feature: Ceres CLONE 1427421-F
MKVLIVALALLALAASAASSTSGGCGCQTPPFHLPPPFYMPPPFYLPPQQQPQPWQYPTQPPHLTPCQQFRSCRVRRVDNPFLGQCVQFLRHQCNPAATPYGSPQCLALQQKSCHHIRQVEPLHQYHATYGVDLQSFLHQQPQGELAALMAAQVAQQLTAMCSLQLHHPG

SEQ ID NO: 38616 - DNA, 683 bp, Zea mays
  misc_feature: Ceres CLONE 1427426-F
  misc_feature: Encodes the peptide sequence at SEQ ID NO. 38617
  misc_feature (416)..(416): n is a, c, t, g, unknown, or other
  misc_feature (461)..(461): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacgggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacngcctccgtggtggggctggcccgtgccacgccggtgttcctgatnctcagccccgtgctggtcccccgccgcgctgctcatcggggacggcccgtcatggggtttcctccacgtcgggccccgctgggggcttcgggggccttgtccttccctcacgtgccttccgcaacacgggcccggaaggggttcccaggcacccccggaataacttgaaggaaggccccccaaagaagggggaaagccccggggccaagcggggccaaaaaa

SEQ ID NO: 38617 - protein, 111 aa, Zea mays
  misc_feature: Ceres CLONE 1427426-F
  misc_feature (15)..(112): Pfam Name: Oleosin Pfam Description: Oleosin
  misc_feature (56)..(56): Xaa is any aa, unknown, or other
MGEQVKGMLHDKGPTASQALTVATLFPLGGLLLVLSGLALTASVVGLARATPVFLXLSPVLVPRRAAHRGRPVMGFPPRRAPLGASGALSFPHVPSATRARKGFPGTPGIT

SEQ ID NO: 38618 - DNA, 635 bp, Zea mays
  misc_feature: Ceres CLONE 1427432-F
  misc_feature: Encodes the peptide sequence at SEQ ID NO. 38619
  misc_feature (612)..(612): n is a, c, t, g, unknown, or other
  misc_feature (621)..(621): n is a, c, t, g, unknown, or other
ggagctccccgcggtggcggccgctctagaactagtggatcccccgggctgcaggaattcgcacgagaccattacctagaacatcctaatcgaaaaatcgcacatattatttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacacaactattaccattcagccagctagctactgcctactctcagcaacaacaacttcttnccattaaancaatggcgcactga

SEQ ID NO: 38619 - protein, 141 aa, Zea mays
  misc_feature: Ceres CLONE 1427432-F
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQHNYYHSAS

SEQ ID NO: 38620 - DNA, 727 bp, Zea mays
  misc_feature: Ceres CLONE 1427438-F
  misc_feature: Encodes the peptide sequence at SEQ ID NO. 38621
ctccccgcggtggcggccgctctagaactagtggatcccccgggctgcaggaattcgcacgagaccattacctagaacatcctaatcgaaaaatatccactattctctaggaagcaagggaatcacatcgccatggcagccaagatgtttgcattgtttgcgctcctagctctttgtgcaaccgccactagtgctacccatatcccaaggaacttgtcaccactactgatgccattggctaccatgaacccatggatgcagtactgcatgaagcaacagggggttgccaacttgctaacgtggccgaccctgatgctgcagaaactgttggcctcaccgcttcagccctgccagatgccaatgatgatgccaggcatgatgccaccgatgacaatgatgccgatgcctaatatgatgccatcaatgatggtgccgactatgatgtcaccaataacgatagctagtatgatgccaccgatgatgatgccaaacatggtttcaccaatgatgatgccaattatgatgccttcgacgatgacacctagtatgatgccaccgataatgatgccgagtatgataccaccgatgatgatacctagcatggtgtcatcaatgataagtgcaaacatgatgacagtgccacaatgttactctgattccctctcgcacattatacaacaacaacaatgtacattcatgatgagccacacagccgtgacgatctcac

SEQ ID NO: 38621 - protein, 198 aa, Zea mays
  misc_feature: Ceres CLONE 1427438-F
MAAKMFALFALLALCATATSATHIPRNLSPLLMPLATMNPWMQYCMKQQGVANLLTWPTLMLQKLLASPLQPCQMPMMMPGMMPPMTMMPMPNMMPSMMVPTMMSPITIASMMPPMMMPNMVSPMMMPIMMPSTMTPSMMPPIMMPSMIPPMMIPSMVSSMISANMMTVPQCYSDSLSHIIQQQQCTFMMSHTAVTIS

SEQ ID NO: 38622 - DNA, 730 bp, Zea mays
  misc_feature: Ceres CLONE 1427439-F
  misc_feature: Encodes the peptide sequence at SEQ ID NO. 38623
aaagctggagctcaccgcggtggcggccgctctagaactagtggatcccccgggctgcaggaattcgcacgagaccattacctagaacatcctaatcgaaaaattccactagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcatttgatccgtcccggccgacttgacttccaccttgttgatcttccctccgaggccagaagctaagctctccctctcgctgagctggctgttgctcttccccaaccccgcgcgcgggggagcgataaaccctagtcttcgccgtcgtcgcaggaggacccgcgatgtcgcacttcgggaggtcaggcccgccggacatccgcgacaccttctcgctcctcgtcctcaacatcagcttccgcaccacggccgacgacctcttcccgctcttcgagcgctacggcaaggtcgtcgacgtcttcatcccgagggacaggaggaccggggactcgaggggtttcgcgttcgtgcggtacaagtacgccgacgaggcgcagaaggctatagatcggctcgatggccgtgatgtggatgggagaacatcatggtgcagtttgcaaagtacggccccaatgct

SEQ ID NO: 38623 - protein, 97 aa, Zea mays
  misc_feature: Ceres CLONE 1427439-F
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSHFGRSGPPDIRDTFSLLVLNISFRTTADDLFPLFERYGKVVDVFIPRDRRTGDSRGFAFVRYKYADEAQKAIDRLDGRDVDGRTSWCSLQSTAPM

SEQ ID NO: 38624 - DNA, 604 bp, Zea mays
  misc_feature: Ceres CLONE 1427443-F
  misc_feature: Encodes the peptide sequence at SEQ ID NO. 38625
  misc_feature (559)..(559): n is a, c, t, g, unknown, or other
aaagctggagctcccaccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtggctgaactcgctgctcaacatgtcggactgcctcccgtacgtgaaccaggggaagcaggggggggccccccgagcgccctgttgcccggagttggngggcctcgtcggttcaaccccgtctgcctctgggaggtcttctcg

SEQ ID NO: 38625 - protein, 104 aa, Zea mays
  misc_feature: Ceres CLONE 1427443-F
  misc_feature (90)..(90): Xaa is any aa, unknown, or other
MVVAAMRRPCAVPALLVAAATATLALLLLLSPSSAQPMPSSPAAAPGPAGGTGIDSAWLNSLLNMSDCLPYVNQGKQGGAPRAPCCPELXGLVGSTPSASGRSS

SEQ ID NO: 38626 - DNA, 701 bp, Zea mays
  misc_feature: Ceres CLONE 1427447-F
  misc_feature: Encodes the peptide sequence at SEQ ID NO. 38627
aaagctggagctccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactaaaaatccccatatccgcggcggcgccgtgcatcggattccatcctcctagcgagtcgactccatctgatcagcggagccgggacaccagccaccatgagggcggcatcatgcctggcgtcatgctgctcggcgagcgcctgctaggcgagccggacaggcgtccgaagcatccgtcgccgctacgcccgcatcgcctactgcggcctcttcccgctctccctcttctcatcctgggggctccgagaagtcgccgcgcccctcctccagtcgatcccatggattaaccacttccacaagacccccgacacgaagtggttcgagacccactcggtgctcatggtcagcctcggaaactacctcttattcaccatcctcaccgtcatcatggccgggatgaaagagcacaaggacccccgtgacaagatccaccacacgctgatggatggacaaaatcttctgctgggtcatcatctcctccctcatgtacttcctgcccaacggggtcaacagcttctatgaatctatatccaagaccggctc

SEQ ID NO: 38627 - protein, 60 aa, Zea mays
  misc_feature: Ceres CLONE 1427447-F
MVSLGNYLLFTILTVIMAGMKEHKDPRDKIHHTLMDGQNLLLGHHLLPHVLPAQRGQQLL

SEQ ID NO: 38628 - DNA, 679 bp, Zea mays
  misc_feature: Ceres CLONE 1427450-F
  misc_feature: Encodes the peptide sequence at SEQ ID NO. 38629
  misc_feature (119)..(119): n is a, c, t, g, unknown, or other
  misc_feature (410)..(410): n is a, c, t, g, unknown, or other
ctccccgcggtggcggccgctctagaactagtggatcccccgggctgcaggaattcgcacgagaccattacctagaacatcctaatcaaaaatcacaatcacaccaccactctttaccnaccgaagagagaaacgcgagcaaccagcgatcgccccatggccgccatggctcgttccgtctccctcgtcgtggcgcccctgctcctcctctccctcctcgtctccgccgcggccagcgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaaggggtccggggatggccaccttcntgcaccgcaagtacagcgacaaggaggacagcgacatggtcaggtgctacgacagctgctccgacgacgtgaaggaaggcgtccccaacctcaacggcctcgtccggaagcccccccacgccaagttcttcgagctcaagtcgtgggttctccccccaccttcgggggcaccttccacctggaaagaacccctgcaaggaccctgccccaaaaccaagggaaaaaggaaaaaacgtctttaaaattttagcccctccacttttcgaaaa

SEQ ID NO: 38629 - protein, 167 aa, Zea mays
  misc_feature: Ceres CLONE 1427450-F
  misc_feature (85)..(85): Xaa is any aa, unknown, or other
MAAMARSVSLVVAPLLLLSLLVSAAASARTVGDTVQDACSKTQFPKICVDSLAAKPESQKATPRKLAELFVNIAAEKGSGDGHLXAPQVQRQGGQRHGQVLRQLLRRREGRRPQPQRPRPEAPPRQVLRAQVVGSPPTFGGTFHLERTPARTLPQNQGKKEKTSLKF

SEQ ID NO: 38630 - DNA, 810 bp, Zea mays
  misc_feature: Ceres CLONE 1427457-F
  misc_feature: Encodes the peptide sequence at SEQ ID NO. 38631
  misc_feature (12)..(12): n is a, c, t, g, unknown, or other
  misc_feature (14)..(14): n is a, c, t, g, unknown, or other
  misc_feature (18)..(18): n is a, c, t, g, unknown, or other
  misc_feature (29)..(29): n is a, c, t, g, unknown, or other
cctccccccctncncccntcccccccgtngggggggaggctgggtcaagctgtgactccccgcggtggcggccgctctattctagtggatcccccgggctgcaggaatttgcacgagaccattacctagaacatcctaatcgaaaaaaaagcggctatgactaccatggcccccgggtacggctgctgctgggcggggattccgcccttcgcgttgttgccgcggattctctctacccgccgggagactcctcctcctcctcctcctcgcgcttcccttgtcgcctcctcctcgaagctcacggcgctggcgccacggctgagagtttcgaaccgtccaaggaggctcattgtctccgcttcctcctccggcgaggccaattcggacgcggcgccgtcgccaacggaagccgctattgatataaagctccctacgaaaagcttgcttgttcaatttacctgcaacccacgtggccaaacgaacacgcgcttgataagcaaagtagcctaggaaaaaggcacagttcttcttccgggtggagggtgccaggtgtaccatcagtttcttgaacaccccccgcccagtggttcaactatgatttacggaaaacaataccctcctcccacggaaaaaacgcggagggacccccgttgcatgaccgatcgccctccctggtaagaaagcggggtaggggccatgctggagggcttatgcattatgcgtgcctgaaatttactagaaatcgcgagaccgtacctccccgctcctcccgtatggggaacttcttctaaatagcctcggggacccccg

SEQ ID NO: 38631 - protein, 117 aa, Zea mays
  misc_feature: Ceres CLONE 1427457-F
MTTMAPGYGCCWAGIPPFALLPRILSTRRETPPPPPPRASLVASSSKLTALAPRLRVSNRPRRLIVSASSSGEANSDAAPSPTEAAIDIKLPTKSLLVQFTCNPRGQTNTRLISKVA

SEQ ID NO: 38632 - DNA, 662 bp, Zea mays
  misc_feature: Ceres CLONE 1427467-F
gctccccgcggtggcggccgctctagaactagtggatcccccgggctgcaggaattcgcacgagaccattacctagaacatcctaatcgaaaaagatggctgagagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagtggcccagctccaagcctccagccatcggcgcccgccctcctccgccgagacgccgagtgccgagcgcccgagcaccccggtccccagcgcccaacaagctagcaggctgcaggtatgcgctctttgttgatgcgtccaaggagttgagctgaatgcccagaaggctagcaggctgcagaaactgaaggaaaaggcggcattcaggaacccggatgagttctattttaaaatgatcaacagtaggactgttggtggaattcaaagacctaagcctgaagataataagtatactgaagaggaacttc

SEQ ID NO: 38633 - DNA, 743 bp, Zea mays
  misc_feature: Ceres CLONE 1427468-F
  misc_feature: Encodes the peptide sequence at SEQ ID NO. 38634
agagctggagctccccgcggtggcggccgctctagaactagtggatcccccgggctgcaggaattcgcacgagaccattacctagaacatcctaatcgaaaaattttcgaccgccgccgcccccagtccccgatccgaagctgtgcctcgtaccatttcgatccaatggcgccgacgtcgaagctgtctacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggagctgatcctcctcacacggcgcttcatggggaagagagtggtgtttctcaagcagctcaagtctggcctgctccttatctctgggcctttcaagatcaatggagtaccgatccgccgtgtgaaccagacctatgtcattgctacatcaaccaaagttgacatctctggtgttgatgtcgccaagtttgatgacaagtactttgccctggagaagaagcagaaggtgaagaacaccgatggcgagctttttgagacagaaaatgaggcatcccagtcactgcctgacttcgagaaggatgaccaggaagctgtgggattctgctctgatcaaagctaacg

SEQ ID NO: 38634 - protein, 191 aa, Zea mays
  misc_feature: Ceres CLONE 1427468-F
  misc_feature (112)..(186): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKAAAAVEPKFYPADDVKPRVPSTRKPKPTKLRSSITPGTELILLTRRFMGKRVVFLKQLKSGLLLISGPFKINGVPIRRVNQTYVIATSTKVDISGVDVAKFDDKYFALEKKQKVKNTDGELFETENEASQSLPDFEKDDQEAVGFCSDQS

SEQ ID NO: 38635 - DNA, 653 bp, Zea mays
  misc_feature: Ceres CLONE 1427474-F
  misc_feature: Encodes the peptide sequence at SEQ ID NO. 38636
  misc_feature (1)..(1): n is a, c, t, g, unknown, or other
  misc_feature (403)..(403): n is a, c, t, g, unknown, or other
  misc_feature (494)..(494): n is a, c, t, g, unknown, or other
nagagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtncaccctccacttggtgctgcgccttaggggaggcatgcagatcttttgtcagaccttgactggcaagacaatcacccttgaggtggagtcntcagaccccattgacaatgtcaagggcaaggatccggaacagggagggggcatccactggacagcaacgtctcatcttttgccgcaagcagttggaagatgggaggacccttgctgaatacaacatccaaaggaaaggcaccttcattgggtgctgcgc

SEQ ID NO: 38636 - protein, 133 aa, Zea mays
  misc_feature: Ceres CLONE 1427474-F
  misc_feature (6)..(74): Pfam Name: ubiquitin Pfam Description: Ubiquitin family
  misc_feature (65)..(65): Xaa is any aa, unknown, or other
MQIFVKTLTGKTITLEVESSDTIDNVKAKIQDKEGIPPDQQRLIFAGKQLEDGRTLADYNIQKEXTLHLVLRLRGGMQIFCQTLTGKTITLEVESSDPIDNVKGKDPEQGGGIHWTATSHLLPQAVGRWEDPC

SEQ ID NO: 38637 - DNA, 703 bp, Zea mays
  misc_feature: Ceres CLONE 1427479-F
  misc_feature: Encodes the peptide sequence at SEQ ID NO. 38638
tccccgcggtggcggccgctctagttctagtggatcccccgggctgcaggaattcgcacgagaccattacctagaacatcctaatcgaaaactagacaacccataaggccataccctccaaccgctggatcgggtatcggcattactgggcgcacgagactagggatttcccccttgcaatcacgaatccatggcggatgctgaacctgttgatcagaagaattaccttgaggaacgttgcaagccgcaatgtgtaaaaacattgtatgattatgagaaatgcgtcaagagagtcgagagcgacggaagtgggcagaagcactgcaccggccaatacttcgactactggtcatgcgttgacaagtgtgttgcaccaaagctcttcgacaaactgaaatgataacggaacgcaactttgaaggcgcggctcctttcaggaagtcaaatagctccaataaacccatgccttggcctctggaatttgtttgctgaacctgtggcagggagcctcattttgatacgttttgctgaaccgtctttgtttttttttccccctgaatctgtgtggtatcccaagcgtcgagcccaatttcttttgtataagaataatgaggtgcccataaaaaatacgccccaagaagattgttcgaatgtacacaagcaaaacaaatttcctcataattggcaactcgaatcctagatg

SEQ ID NO: 38638 - protein, 69 aa, Zea mays
  misc_feature: Ceres CLONE 1427479-F
  misc_feature (7)..(69): Pfam Name: UCR_hinge Pfam Description: Ubiquinol-cytochrome C reductase hinge protein
MADAEPVDQKNYLEERCKPQCVKTLYDYEKCVKRVESDGSGQKHCTGQYFDYWSCVDKCVAPKLFDKLK

SEQ ID NO: 38639 - DNA, 707 bp, Zea mays
  misc_feature: Ceres CLONE 1427481-F
  misc_feature: Encodes the peptide sequence at SEQ ID NO. 38640
ccccgcggtggcggccgctctagtactagtggatcccccgggctgcaggaattcgcacgagaccattacctagaacatcctaatcgaaaaaaaatagcaaatttctctagggggagcaggggctgagagagggctgcggagcaaggaatcaaggacgagccgccgagaggactagggtttagccatggcggccgaggaccagactccttgtaccaagctccgccccggcaaggcaaagacgcggaagaagacgaagagggacaagtggggccagcctatctccgccgccgccgccgatgaggagccgtcggtggagccggagcaagagcacccggcgggggtagttgaggcggcagtacaggtggagaaggaggaggaggaagaggcgactgcggcggcggaaggctatgagcccgggaaggtggtggcgagcggcttgccctacacgaccaccgaggcggacatccggaagctgttcgagttctacgggcccatccagtcgatgcagctctctcgcttcccggactccggcaacttccgcggccttgccttcctctgcttcgaggtccatactccatagcaaccacacttccttcttcagaagaagatgcaataaagtctcttgagcttgatggattcaaaattggcagcagatacatgagggtttgaaaggtgcagggtgaccgccacctcaaacaagaaggagg

SEQ ID NO: 38640 - protein, 131 aa, Zea mays
  misc_feature: Ceres CLONE 1427481-F
MAAEDQTPCTKLRPGKAKTRKKTKRDKWGQPISAAAADEEPSVEPEQEHPAGVVEAAVQVEKEEEEEATAAAEGYEPGKVVASGLPYTTTEADIRKLFEFYGPIQSMQLSRFPDSGNFRGLAFLCFEVHTP

SEQ ID NO: 38641 - DNA, 718 bp, Zea mays
  misc_feature: Ceres CLONE 1427482-F
  misc_feature: Encodes the peptide sequence at SEQ ID NO. 38642
  misc_feature (718)..(718): n is a, c, t, g, unknown, or other
agagctggagctccccgcggtggcggccgctctataactagtggatcccccgggctgcaggaattcgcacgagaccattacctagaacatcctaatcgaaaaagtggttgctgtgcaatcagctagtagctaggtagtcgaggttctccttgcctctccttggctccttccatcattccatcgtctttgctcgaggagtcgaggttcaggttccacggtgcggcgagagctagctcgcagccatggagagcaagagcccatggtcgctgcggctgctaatttgctgcgcggcaatggtggccatcgcgcttctcccccaacaaggaggccaggccgcttgtttcgtgccgacgccgggtccagctccggcaccgcccggctcctccgcgacgaacacgaacgcctcctccgctgctcctcggccagccaagcccagcgcattcccgcccccaatgtacggtggtgtcacccccggcaccggcagcctccagccccacggtccgtaccgtacgcgactttagctaaaagagagcagcacctctctgaagtctgaaccgcacggtcgtcgtcaattaataaaggtttcgctgtgctgcgtgtgcgtgtttgcaacatattgcggcggccggtgcgcggagcggtgctcggcgacggcgtaccagaagccgtgcctcttcttctggcgcaagtgctgcgcgggcgtgcctgtgcgttccgn

SEQ ID NO: 38642 - protein, 92 aa, Zea mays
  misc_feature: Ceres CLONE 1427482-F
MESKSPWSLRLLICCAAMVAIALLPQQGGQAACFVPTPGPAPAPPGSSATNTNASSAAPRPAKPSAFPPPMYGGVTPGTGSLQPHGPYRTRL

SEQ ID NO: 38643 - DNA, 705 bp, Zea mays
  misc_feature: Ceres CLONE 1427488-F
ccccgcggtggcggccgctctagatctcgtggatcccccgggctgcaggaattctcacgagaccattacctagaacatcctaatcgaaaaaaccaaacgcaatggtttgttctctcattctcttttgtctcctttctctttgtaatgaagttgtgttatagatatgaatattgtttcttgttatgcttttatttatttgcgttcacataagatcatattggtttattgtcccatttacaatcttggattacggtttatccatatactatgaattggaaaggcgaacgcagcgtcaggaatggcggtggaagacgaatgtaagttgaagtttttggagctaaaagcgaaaagaaactataggttcataatattcaggatagacggacaacaagtggtggttgagaagcttggaagtcctgaggagaactacgacgatttctccaattccttacctgccaatgagtgccgctacgctgtctatgacttcgacttcaccactgctgagaattgccagaaaagcaagatcttcttcatagcatggtcaccggattcttcgagggtaagaatgaagatggtgtatgcgagctcaaaagacaggttcaagagagagttggatgggattcaggtggagtttacagccacagacccgagcgagatgagtttcgacatcatcaaaagtcgagctctctagattcatatgtgcct

SEQ ID NO: 38644 - DNA, 669 bp, Zea mays
  misc_feature: Ceres CLONE 1427489-F
  misc_feature: Encodes the peptide sequence at SEQ ID NO. 38645
gctctagatctcgtggatcccccgggctgcaggaattctcacgagaccattacctagaacatcctaatcgaaaacccgtccctctcccacccttttcagatctgcctgcgagcccccgccacgcacccccatgcccatgcggccatgcccatgaccccccgacgcgaggccactactgccaatggctccctgccgtgaccgagcccatggaggacctcgccccgggggccctcgcactcttcgccgccgtcgctgacttcatagacgactccgctcctgctgccgccggggccgggatgccaccgccggagcccgagtccgcgcccgggagtccctgctccgactgcagcagcgtcgccaccgccgacttcgagggcttcgccgacctcgcctccacgctcgtgctcgacgacctcgtctcccccgcctccgcctccgcctccgccagctcgctccccgcctccgggcccagggccgcccaggagcgtcttcgcgctcgactgcgtgccgcgctgggggactccccttcccgggtgcgggccaaaggccccaaaatggggggaaccccccccccccggggcctccccaaactctttttttacaagttccccgcttttgggagtaggcctccgccgggggagagacacccccgcccctttaaaaaagagc

SEQ ID NO: 38645 - protein, 154 aa, Zea mays
  misc_feature: Ceres CLONE 1427489-F
MEDLAPGALALFAAVADFIDDSAPAAAGAGMPPPEPESAPGSPCSDCSSVATADFEGFADLASTLVLDDLVSPASASASASSLPASGPRAAQERLRARLRAALGDSPSRVRAKGPKMGGTPPPRGLPKLFFYKFPAFGSRPPPGERHPRPFKKE

SEQ ID NO: 38646 - DNA, 669 bp, Zea mays
  misc_feature: Ceres CLONE 1427492-F
  misc_feature: Encodes the peptide sequence at SEQ ID NO. 38647
gcggtggcggccgctctagatctcgtggatcccccgggctgcaggaattctcacgagaccattacctagaacatcctaatcgaaaaacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggtgcgtatgccctgtctcagggactaaggtcatggcctgtgttggtgaaacacttgagcaaagggagctgggtctacctggaagttgttgctgccaaaacaaaacaattggtaaaaaatcagggccggaacaaccaatttgttg

SEQ ID NO: 38647 - protein, 121 aa, Zea mays
  misc_feature: Ceres CLONE 1427492-F
  misc_feature (5)..(121): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVRMPCLRD

SEQ ID NO: 38648 - DNA, 799 bp, Zea mays
  misc_feature: Ceres CLONE 1427497-F
  misc_feature: Encodes the peptide sequence at SEQ ID NO. 38649
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (485)..(485): n is a, c, t, g, unknown, or other
gccgggtcgggcggatcatggggggaggaagggnnnaaggggantgttttcagactagagctcaccgcggtggcggccgctctagactagtggatcccccgggctgcaggaattcgcacgagaccattacctagaacatcctaatcgaaaaaatcgcatcggcctacctgcactgcactctaaaacatgcctgccgtacgatccagggaagtgtcaaatcacgtgttgagtctgcgaggttgtgaaagcatctgacgcctcccctcccgacgcacgacgtcccgttctcagacccagacccctcccgggacaacttgtaggtctccagagtgtgtctctaccccgagccgtcaacaaagttcggtacggggagaggattctacgaaaatcatatgcacttacaagacctccgatggcacgactggatgatacagctataaacagggtagattgggtcaccttgggggccccccccccccctcccnggaggaagggaaaagttcacattccgaaaagcccaggccctcccggagctcttttattccggaaggaacggcgagccgttgcacggctggggggggccagaggaataagcgtgcctcggcggggggggggggaccgaacctaaggaccggtgttaatcaaacgcccctggaagcacaagacacgactcgcgggtggccggtagcaaatcccgtgcgaacaaacaaagggttgcgtcccctccctggagcgacccgacaagccgccccccccggaactatggtggggcgcacaaatccgttggggggacaaaggg

SEQ ID NO: 38649 - protein, 29 aa, Zea mays
  misc_feature: Ceres CLONE 1427497-F
  misc_feature (12)..(12): Xaa is any aa, unknown, or other
  misc_feature (15)..(15): Xaa is any aa, unknown, or other
AGSGGSWGEEGXKGXVFRLELTAVAAALD

SEQ ID NO: 38650 - DNA, 696 bp, Zea mays
  misc_feature: Ceres CLONE 1427501-F
  misc_feature: Translation starting site: 521
  misc_feature (638)..(638): n is a, c, t, g, unknown, or other
  misc_feature (643)..(643): n is a, c, t, g, unknown, or other
  misc_feature (667)..(667): n is a, c, t, g, unknown, or other
aagctggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaaggctgaggacgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacngcatncagaagatgactatcatgttgacnattgtcgacgatcttgtgtccatcgacac

SEQ ID NO: 38651 - DNA, 642 bp, Zea mays
  misc_feature: Ceres CLONE 1427522-F
  misc_feature: Encodes the peptide sequence at SEQ ID NO. 38652
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (547)..(547): n is a, c, t, g, unknown, or other
  misc_feature (548)..(548): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggacccgcaggaggacctgcggtggttgccaaccaggcctgccaaattggccattcccggaaaaaaggaaccccccccccccccaaaaaaaaagagaaaagttttttagagagggggggtgtgggtttnnnaaaggggggcccccccacaatttctctcgggaaagaaaaaacccggggggggggcccccccccccccccccccggggggggggggggggggggggnntctttttttttttcccccccccccggcgggggggggggggggggagaaaaaaaaaaaaaaaattggtgggggggggcgcccgcccccccccccc

SEQ ID NO: 38652 - protein, 71 aa, Zea mays
  misc_feature: Ceres CLONE 1427522-F
MGKGSVGASWWAFLLLAGVLLVVAATAGAEDGVVERDPQEDLRWLPTRPAKLAIPGKKEPPPPPKKKRKVF

SEQ ID NO: 38653 - DNA, 721 bp, Zea mays
  misc_feature: Ceres CLONE 1427540-F
  misc_feature: Encodes the peptide sequence at SEQ ID NO. 38654
aaagctggagctccccgcggtggcggccgctctagaactagtggatcccccgggctgcaggaattcgcacgagaccattacctagaacatcctaatcgaaaaaaggaaatgtcccggtttagaattcggccctttatactatagctgttcgtttgggcccagattgaaaccgagagtgatccgatttgaagttttctcttctacaacggcccgacatgaatcctggtctactgacctccggatccgatctcgacgacacagcgcagcactggcgcagaggaggcaaagaggcgacgacaccagtgacggcgtggcggcgcagcgcagcgtcgacggccaccctcccgtcgctttctcaccgtgcagaaaattggcgttttgcggcaaagcacttcatcaggaaacaccctgaagacgtggttgttcactgcagtgggtgcaactcagcagctcgaacctttgatggagttgatgtgatggggagaagattggcagacgaggtggcttctattgttgacagtagaccagagctttgcaagatttcctttgttgcgcattcattgggtggactaattgcaagatatgctattgcattattatatgagagcgagacacaaaaagattctcatgaaaagtttgagaaccatgctgttgactattctagtaaccagcacagcatagggaaaattgctggtttggagcctattaacttcatcacttt

SEQ ID NO: 38654 - protein, 168 aa, Zea mays
  misc_feature: Ceres CLONE 1427540-F
  misc_feature (1)..(167): Pfam Name: DUF676 Pfam Description: Putative serine esterase (DUF676)
MNPGLLTSGSDLDDTAQHWRRGGKEATTPVTAWRRSAASTATLPSLSHRAENWRFAAKHFIRKHPEDVVVHCSGCNSAARTFDGVDVMGRRLADEVASIVDSRPELCKISFVAHSLGGLIARYAIALLYESETQKDSHEKFENHAVDYSSNQHSIGKIAGLEPINFIT

SEQ ID NO: 38655 - DNA, 725 bp, Zea mays
  misc_feature: Ceres CLONE 1427548-F
  misc_feature: Encodes the peptide sequence at SEQ ID NO. 38656
aaagctggagctccccgcggtggcggccgctctagaactagtggatcccccgggctgcaggaattcgcacgagaccattacctagaacatcctaatcaaaaaaaacaaaaaccctagccgccgcgccgccccgctccctagtggtcctaccctcccccaccactgcagctgccgtcccggcggccccaagagttgcggcgaggatgaacgtgaagggcggcagccggattccggtaccccctccgggggccagcgcgctggtcaaggtggccgtgttcggcggcgccgccgatgtactctgccttgaacagcctctacaacgtcgagggtgggcaccgcgccatcgtcttcaaccgcatccaggggatcaaggacaaggtataccccgaagggactcactttatgattccatgggttgaacgaccaatcatttatgatgtccgtgctcgaccgaatcttgttgagagtacttctgggagtcgggatcttcagttggcgaaaattggtctccgtgtccttacaaggcctatgccagagatgctaccacatatctacagaactctgggagagaacttcaatgagagagttttgcctgcaatcatccatgatacacggacagctgttgttgctcaatatcatgctagtcagctgatcacacagagagagactgtgactagggagattatgagcaactgactgagagggctagattcttcaacattgcg

SEQ ID NO: 38656 - protein, 134 aa, Zea mays
  misc_feature: Ceres CLONE 1427548-F
MYSALNSLYNVEGGHRAIVFNRIQGIKDKVYPEGTHFMIPWVERPIIYDVRARPNLVESTSGSRDLQLAKIGLRVLTRPMPEMLPHIYRTLGENFNERVLPAIIHDTRTAVVAQYHASQLITQRETVTREIMSN

SEQ ID NO: 38657 - DNA, 724 bp, Zea mays
  misc_feature: Ceres CLONE 1427549-F
  misc_feature: Encodes the peptide sequence at SEQ ID NO. 38658
  misc_feature (18)..(18): n is a, c, t, g, unknown, or other
  misc_feature (24)..(24): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
ggggggggggggcggggngaaaancccncnntcctntcntnntccnctcttgctttcaaaactggagctccccgcggtggcggccgctctagaactagtggatcccccgggctgcaggaattcgcacgagaccattacctagaacatcctaatcgaaaactcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatggggccgtataggaagcggggggagggctccccaagacgctgcagctggggtcgctcttcgggctctggtacctcttcaacatctacttcaacatctacaacaagcaggttctgaaggttctgccataccccttaaacatccccccagtgcagttttgccgttggaagtgcccattgcttttgttttatgtgggatcacccggctttcccataaaaggcccaaagaattttctgggtgcccctggctgtttttggctatccctttccctcttagcttatg

SEQ ID NO: 38658 - protein, 84 aa, Zea mays
  misc_feature: Ceres CLONE 1427549-F
MQSTAAIGLVRPCAARPLPTYPSPRRGAGACSGAAQPILAPRGLCLSARASLLPDSPLEEEYRRCRAGRHVAAAGKVAAADGAV

SEQ ID NO: 38659 - DNA, 685 bp, Zea mays
  misc_feature: Ceres CLONE 1427558-F
  misc_feature: Encodes the peptide sequence at SEQ ID NO. 38660
tccccgcggtggcggccgctctatacctagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggccacgcccacgctggccgccgtgcgggcgctcttcgagctccgctcccaccgcgcgctgctggccgccaacggcctcccgctctccacgccgcccacggcgcccgcgcccgtgccgctgcgggtccgcctgccctgcctctgctcggggggcgccggggccacgttccagcggcc

SEQ ID NO: 38660 - protein, 113 aa, Zea mays
  misc_feature: Ceres CLONE 1427558-F
MAPLPASLTPCLWLFLCLLAAPCPAARAARFACNATAPRASTCQALVSYAPPNGTATPTLAAVRALFELRSHRALLAANGLPLSTPPTAPAPVPLRVRLPCLCSGGAGATFQR

SEQ ID NO: 38661 - DNA, 640 bp, Zea mays
  misc_feature: Ceres CLONE 1427562-F
  misc_feature: Encodes the peptide sequence at SEQ ID NO. 38662
  misc_feature (459)..(459): n is a, c, t, g, unknown, or other
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaaacacacccccgaccgcccgcacatctgcggctgccntcagaacgtcgccnaacgcgccaacgggagcggcacctacatcagccgcgccgccgcgctgcccagcaaagtggggcgtcgcccctgcccgtacagatcagccaccaacgtttactgccacacgattaattaagtgatgaggcgttcctgtcccccttccgggcaaagaatgcatgcttgg

SEQ ID NO: 38662 - protein, 124 aa, Zea mays
  misc_feature: Ceres CLONE 1427562-F
  misc_feature (32)..(120): Pfam Name: Tryp_alpha_amyl Pfam Description: Protease inhibitor/seed storage/LTP family
  misc_feature (81)..(81): Xaa is any aa, unknown, or other
  misc_feature (86)..(86): Xaa is any aa, unknown, or other
MAAPKLATLALAVLLAATVVAPPAAVRAAMSCSTVYSTLMPCLPFVQMGGAMPPQPCCGGIRSLLQQAKHTPDRPHICGCXQNVAXRANGSGTYISRAAALPSKVGRRPCPYRSATNVYCHTIN

SEQ ID NO: 38663 - DNA, 625 bp, Zea mays
  misc_feature: Ceres CLONE 1427563-F
  misc_feature: Encodes the peptide sequence at SEQ ID NO. 38664
ctggagctccccgcggtggcggccgctctagaactagtggatcccccgggctgcaggaattcgcacgagaccattacctagaacatcctaatcaaaaaatctgccatcttcgtctatccctttcatctcagttttgcagtttctactgctgtcttcgctccgaaatccaaccgaaatctcagaggaaagtaggaaacctcgttcgggaacctgctttgagtgagactccaatccttgggcgccattgccgcctgttttttgtgctcggaaaggcgctgtctgattcctgtatatttattttggcaatgctttcagctgcaacaaaactaaccatggatggcactagctttgacctgacagagcacgaaggttcaaatttgtctccttttctactcaaactttttaatgagtgggatgatcgcaagacaaggggcttgtttcaccatgacatcagttcctgtgaaacaaggtgctacctggagtacataattttgtggcacatttatttgaagacgtgaccaaaagaggcggcaactgagttcacatgaaccaagtctccaccatttgttagtgaaagtcaatttcccaaagtcagccgttgggagtgatctttaaattcaaggaa

SEQ ID NO: 38664 - protein, 61 aa, Zea mays
  misc_feature: Ceres CLONE 1427563-F
MDGTSFDLTEHEGSNLSPFLLKLFNEWDDRKTRGLFHHDISSCETRCYLEYIILWHIYLKT

SEQ ID NO: 38665 - DNA, 720 bp, Zea mays
  misc_feature: Ceres CLONE 1427601-F
  misc_feature: Encodes the peptide sequence at SEQ ID NO. 38666
  misc_feature (624)..(624): n is a, c, t, g, unknown, or other
aaagctggagctccccgcggtggcggccgctctagagtcatgaatcgggcgggctgcaggaattcgtaccagaccattgcctagaacatcctaatcgaaaaatcaagtacccaaaccctttcgatctgctcaactaccaaactctgctcctccctgcttccgtcacgcgagagcactccactcccacgcgaaccctagcagtggttctccctcggggccccgctaagcagcttggttccaagctgtagaagcatctccgatcccatccgcggcgggttgaggccatcagctccggtttctgcagccggatttgggatccgcgagatgtcttggtccgcgcccgacgacatcctcctctccacctccctcgccggcttcttggacacaaatggtgttcttcagggtgcttgtgaacgagtgattgtgggggaacaatattgtgatgttcctcttgggctgtacgtaatccggggagagaacgttgttttaatcggagaattggatcgcgaaaaggatgaactccctgctcacatgacctgtgtttcagaagcagaaataagaaaggctgaaaaggcagaacgggaagccagagatctgaaagggacgatgaggaaacggatggangtcctggacttcgattaacaccgtcaccgcggccgttgccgctccccattgtggcggaatctttagtggcgggctgtgtgccatacatgcctggtg

SEQ ID NO: 38666 - protein, 105 aa, Zea mays
  misc_feature: Ceres CLONE 1427601-F
  misc_feature (100)..(100): Xaa is any aa, unknown, or other
MSWSAPDDILLSTSLAGFLDTNGVLQGACERVIVGEQYCDVPLGLYVIRGENVVLIGELDREKDELPAHMTCVSEAEIRKAEKAEREARDLKGTMRKRMXVLDFD

SEQ ID NO: 38667 - DNA, 566 bp, Zea mays
  misc_feature: Ceres CLONE 1427603-F
  misc_feature (212)..(212): n is a, c, t, g, unknown, or other
aagctggagctccaccgcggtggcggccgctctagaactagtggatcccccgggctgcaggaattcgcacgagaccattacctagaacatcctaatcgaaaaaaacgcaggccgcagtcgcgtgcggaactagagctccttcagagaagtgccgtgccagtgccaccgccggccgcatcatcgttccgcccccctgagtgttcagtaacttncttccgatccatatttatgggctttcaaagcagcagcagaaaaacgggtccctggggatgaagcccatgaattcaagcagccccgaaacccggaagggaggaacccgtgggggggggccccaggggccccccccaagggggtaaaaaaaaatccgggggtttttgggggatttcccctaaaaaacttttttaaaaacttttttttttttggggggggggtggggggcccccccgggggggccccaaaaagggggggggggagtttttttttttaaaaagaaattaatacccccccccccccggggggggggggggggggcgccccctccctccctccccctttaattaaacggg

SEQ ID NO: 38668 - DNA, 720 bp, Zea mays
  misc_feature: Ceres CLONE 1427607-F
  misc_feature: Encodes the peptide sequence at SEQ ID NO. 38669
aagctggagctccccgcggtggcggccgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccggggtcctcctcctcccgggctcccgcccctggggcctcctccagccgggctcctgcccccggggcctccttcgaccccttcgatgtcgataccgacccgccatcgcggcttgagctgacgcccgagcagatcgggctctgcgttgacgcgctcgcgcatttcgagtacaagggggaagcgccgggatgacttgtccgacgagttcagaagcctctcggtatcggatattagacatatgaaaacgatcagtgtagctcattatcctggtaatagagaaaaggaccgatatattgatgtcttaccttttgacgatcccggaggacggcttaaatcctcagcccggcctccaaaacaacgattacttcaatggaagccttaataaaggctactgg

SEQ ID NO: 38669 - protein, 81 aa, Zea mays
  misc_feature: Ceres CLONE 1427607-F
MLMRAAAALPRRSSRPSEPGSSSSRAPAPGASSSRAPAPGASFDPFDVDTDPPSRLELTPEQIGLCVDALAHFEYKGEAPG

SEQ ID NO: 38670 - DNA, 663 bp, Zea mays
  misc_feature: Ceres CLONE 1427608-F
  misc_feature: Encodes the peptide sequence at SEQ ID NO. 38671
aaagctggagctcaccgcggtggcggccgctctagaactagtggatcccccgggctgcaggaattcgcacgagaccattacctagaacatcctaatcgaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgtcggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatccctgggccagtgcgtccaagttcctgaggcatcagggcaacccggacggcggacccccctactgctccccctcagtggccaagtcgttgccggcaacaagtggttgcccagcagcctcca

SEQ ID NO: 38671 - protein, 132 aa, Zea mays
  misc_feature: Ceres CLONE 1427608-F
MRVLLVALALLALAASATSTHTSGGCGCQPPPPVHLPPSVHLPPPVHLPPPVHLPPPVHLPPPVHLPPPVHVPPPVHLPPPPCHYPTQPPRPQPHPQPHPCPCQQPHPSPCQLQGTCGVGSTPIPGPVRPSS

SEQ ID NO: 38672 - DNA, 723 bp, Zea mays
  misc_feature: Ceres CLONE 1427614-F
  misc_feature: Encodes the peptide sequence at SEQ ID NO. 38673
aaactggagctccccgcggtggcggccgctctagaactagtggatcccccgggctgcaggaattcgcacgagaccattacctagaacatcctaatcgaaaaaagagaataaaagacagccccacacgcagctcgaatcccggcacgtgagcggcggaggcagggacggccatggcatgcagtgggtgcagctgcgaggcggcggtgggggcgatggcgtccgaggcgtaccttgagggggcgccggtgcgggaggcgcgggagctggtggcggagctctgtcggcacttctacgcgcagggatgggtcacgggcaccggcggcagcatcaccgtcaaggtcaacgaccccgccgtgccgctcgccgaccgcctcatcgttatgtcaccttccggtgtgcagaaagagaggatggtacgacaggacatgtatgtgatggctgcagatgggaaagtgctttctgcgcctgtagcaaagccatggccaaacaagcctcctaagtgcacggactgtgctcctctgttcatgaaggcgtatctgatgagaggagctggggctgtcattcacagccatgggatagagacttgcatcgcaacaatgctcatccctggtgcaaaggagttcagagtgaccccccatggaaatgatcaaaagaatcaaaaggtcatggctacccatgatggaattggtccattcctatttatggagaaaaccccctttatgg

SEQ ID NO: 38673 - protein, 184 aa, Zea mays
  misc_feature: Ceres CLONE 1427614-F
  misc_feature (31)..(180): Pfam Name: Aldolase_II Pfam Description: Class II Aldolase and Adducin N-terminal domain
MACSGCSCEAAVGAMASEAYLEGAPVREARELVAELCRHFYAQGWVTGTGGSITVKVNDPAVPLADRLIVMSPSGVQKERMVRQDMYVMAADGKVLSAPVAKPWPNKPPKCTDCAPLFMKAYLMRGAGAVIHSHGIETCIATMLIPGAKEFRVTPHGNDQKNQKVMATHDGIGPFLFMEKTPFM

SEQ ID NO: 38674 - DNA, 1030 bp, Zea mays
  misc_feature: Ceres CLONE 1427620-R
aattgggtacgggccccccctcgaggtcgacggtatcgataagcttttttttttttttttttaatgaattgcaacaagcttttatatttgatataacatacgtatactacagggtgacgacggaaatatagatttagacacatgcatgcatggcatttatttggcacatggcgatggcagccgtagacacaaaaccacttttatttatttgacatgaacacacatacgacagctccggacgacgatgatagctacatgaccagatcaaagttgttgacgcaggtaaacaccgatcgcagcgacaagcctgctggtctagcgtccatagaaccccacgatgctgctgccgatcggctcgatgatgcacaaaccggggccgtactctttcccccatgggcgccaggacccccccgctgagtgaagaactcctgaccccgggccaccaaggcggccccctttcaacatgcgcgtattgttcccttaaaaccatccctgaaaaaccttccccggcactccccaaaaccggaaccggtctcaaaggttagacccccaaaaattgcaacccgcgatcagaccctaattgcttattccccctctccgggctaaaccactgctcattcaatggcattaccctgtaaaaaaaccacataatggggattattagtatatcgcgcgccagaaaaccacaagtctcctcgtaaaccagctcataaacatacctaacgcactaataaaacacaactatggggatgggtggctcacccttctcaaccccctagtggaagggtgccggtcggggatgactgaaaagagcgacgacagactattggaccaccactttaataaatacaaggtgaatgggaggtgacaacgaagactgccggcgagaccccgaggggagctatttgtgacgggtaaagagcgtagggcacaaatacagcactaaagatccaagcggcacgtcaaaacgcttgtgggaatagtcgctgacaatctcacggcagttggaaccccgaaaacacaaaagcaa

SEQ ID NO: 38675 - DNA, 607 bp, Zea mays
  misc_feature: Ceres CLONE 1427621-F
  misc_feature: Encodes the peptide sequence at SEQ ID NO. 38676
ctccccgcggtggcggccgctctagaactagtggatcccccgggctgcaggaattcgcacgagaccattacctagaacatcctaatcgaaaaatcggagagcaattatggcttcaggtttcagcggcgatgaaactgctcctttcttcggattcctcggcgctgccgccgctctcgttttctcatgtatgggagcagcgtacgggacagcgaagagcggggtcggcgtggcgtccatgggtgtgatgagaccagagcttgtgatgaaatcgattgttcccgtggtcatggctggtgtgttaggtatctatggtctcatcattgctgtcatcatcagtactggaatcaaccctaaggccaagtcttactacctcttcgacggctatgctcatctctcttccggtctcgcttgtggtctcgccggtctctccgccggtatggctattggtatcgtcggcgacgctggtgttagagcgaatgcacaacaaccgaagctgtttgtgggaatgattttgattctcatctttgctgaagcactttccccttgaccgacccattgggttggaataaaccctcccaaccccggggggggccaattttaaaaccca

SEQ ID NO: 38676 - protein, 146 aa, Zea mays
  misc_feature: Ceres CLONE 1427621-F
  misc_feature (14)..(79): Pfam Name: ATP-synt_C Pfam Description: ATP synthase subunit C
  misc_feature (93)..(145): Pfam Name: ATP-synt_C Pfam Description: ATP synthase subunit C
  misc_feature: SWISSPROT Homolog: EC 3.6.3.14 H(+)-transporting two-sector ATPase
MASGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALSP

SEQ ID NO: 38677 - DNA, 742 bp, Zea mays
  misc_feature: Ceres CLONE 1427623-F
  misc_feature: Encodes the peptide sequence at SEQ ID NO. 38678
  misc_feature (451)..(451): n is a, c, t, g, unknown, or other
  misc_feature (452)..(452): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggnncgcatcgcgctggcgctcatgggcgcccggttcgtcacctccggcggcctcggcgtcgctgcgctgtccgtgttctcctgnatgtacaagtacctgacgggcaagcacccgccgggcgccgaccagctggaccacggccagggcgagctggcgtccaaggcccgcggacatcaggatgcagcacagcaccgcatcgaccaggcgcaggggtcttgagagaagaccacactcgagcggaacgggcgcgcgacctccttgaacactggccggcgcgcggcatatggccttaa

SEQ ID NO: 38678 - protein, 156 aa, Zea mays
  misc_feature: Ceres CLONE 1427623-F
  misc_feature (36)..(146): Pfam Name: Oleosin Pfam Description: Oleosin
  misc_feature (85)..(85): Xaa is any aa, unknown, or other
  misc_feature (112)..(112): Xaa is any aa, unknown, or other
MADHHRGATGGGGGYGDLQRGGGMHGEAQQQQKQGAMMTALKAATAATFGGSMLVLSGLILAGTVIALTVATPVLVIFSPVLVPXRIALALMGARFVTSGGLGVAALSVFSXMYKYLTGKHPPGADQLDHGQGELASKARGHQDAAQHRIDQAQGS

SEQ ID NO: 38679 - DNA, 605 bp, Zea mays
  misc_feature: Ceres CLONE 1427625-F
  misc_feature: Pfam Name: S6PP Pfam Description: Sucrose-6F-phosphate phosphohydrolase
aaagctggagctccccgcggtggcggccgctctagaactagtggatcccccgggctgcaggaattcgcacgagaccattacctagaacatcctaatcgaaaaagcatttgttctttgcccacttgcctccctccaggctccagtccggccggtcctgatctctgtccagctagctagctagcgcctccagccgtccagccagcggcggcgcgacgattcttccctccccggccggaagcccccgcacgccgccgcccctgcaggcaagctgagttgtctctgccagagatggataggctcggcggctctgcccgcctcctgctcgtctctgatctgggaccagacgatgatcgaccatgatgaccgggagaacctgtcgtgctaaagtttaagcgctgtgggagggcgattcgccccagactctctgctggtcttctcacggggaagacgcccgtgactacaaggcttgcggaaggaacagcctctggtgactccgaactgacatcatgtccggtggggaacgtgaaaccttacggcaagaaaagggccctgacatcggctggaaaaaaacgcttggaacaacaactgggaaacagggcccctcc

SEQ ID NO: 38680 - DNA, 708 bp, Zea mays
  misc_feature: Ceres CLONE 1427632-F
  misc_feature: Translation starting site: 173
  misc_feature (495)..(495): n is a, c, t, g, unknown, or other
  misc_feature (503)..(503): n is a, c, t, g, unknown, or other
gctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcccgctgttcgtggcggtgtctgtgggcccaacatctccggcgggaacgtgaaccctgccgtgaccttcggcgccttcgtgggcggaacatcaccctgttccgggggctctgtactgggtggngcacgtgntggggtccacgtggggtgcttcctggtccgtttctgaggggggggaggccacggcacctttcgggttaacgggcctgttcgtttggggagggcttggtgctggaaaaccggatgacccttccggctgggggtaagcggagtacccccacctccggttgaaccccaaaaaaaggggaagacctgggaaccctttcccccccaattg

SEQ ID NO: 38681 - DNA, 723 bp, Zea mays
  misc_feature: Ceres CLONE 1427633-F
  misc_feature: Translation starting site: 132
  misc_feature: Pfam Name: tRNA-synt_1d Pfam Description: tRNA synthetases class I (R)
  misc_feature: Pfam Name: DALR_1 Pfam Description: DALR anticodon binding domain
  misc_feature: SWISSPROT Homolog: EC 6.1.1.19 Arginine--tRNA ligase
  misc_feature (547)..(547): n is a, c, t, g, unknown, or other
  misc_feature (548)..(548): n is a, c, t, g, unknown, or other
  misc_feature (673)..(673): n is a, c, t, g, unknown, or other
  misc_feature (723)..(723): n is a, c, t, g, unknown, or other
aaactggagctccccgcggtggcggccgctctagaatagtggatcccccgggctgcaggaattcgcacgagaccattacctagaacatcctaatcgaaaatacagatgttggtcagcagcagcactttgacatggttttcagtgctgcaaagatggccggttggctcccagatccaagtgaaaagaagtttccgaaaacaagccatgttggatttggtcttgttcttggttcagatggcaagcggttccgaacccgcagtactgaggttgttcgattggtagagctacttgatgaggctaaatctcggagcaaatcagaactactacaacggctcactgaaaatggcaaaattgttgactggacggatgaggaattagagcaaacttcagaggctgttggatatggtgctgtgaagtacgctgatctaaaaataacaggctcactaattacacatttagttttgaacaaatgctgagcgataagggaaatactgctgtgtaccttcagtatgcacatgctcgtatttgttccattattcggaatccnnacagaacgtggaagagctgaagatgagtggagccatttctctcgaccatccgatgagcgcgtgttggggctgtatcttatccgatttgcagaggtttgtgaagagcatgcacgaatctacttccnaaatgtgtgtgtggatacttgtacaatctatctgaaaatgtcacaaattn

SEQ ID NO: 38682 - DNA, 740 bp, Zea mays
  misc_feature: Ceres CLONE 1427634-F
  misc_feature: Encodes the peptide sequence at SEQ ID NO. 38683
  misc_feature (494)..(494): n is a, c, t, g, unknown, or other
aagctggagctccccgcggtggcggccgctctagaactagtggatcccccgggctgcaggaattcgcacgagaccattacctagaacatcctaatcgaaaatcccgttccaactcctacctacgcagcagaggccagccacctccccgtcgctctcacgctcttcgtgcccgccgcctctcctccgtctctgcctctctccctctcccctcccgtctgacgcacatggcctccatcgccggatcttcggccctctccttcgccaggcccgtcaaggcaatcaacacaaattctctagctttctccccggcgaggaagggcaacacattcctccgcctgcaaccaatgcctatgagatctgtttcctgcgctgccaagaaggatacaacagacaaggtttgtgagattgtgaagaagcagcttgctcttcctgaccatactgaagtttgcggtgaatcgaaattctctgaactcggtgcagattcactggacacngttgagattgtgatgagtctcgaggagcacttcgatattagcgtggaggagtccagcgcacaaaacaatcgcacagtttgagacgccgcggaactcatcgacaagcttggtgctggcaaagcgtagttctgtacctcctctatcgttgtcctacactctaggtctatcccttgatctaggtttctatgggctgaagattgtgattttctccgcactgtgttgctatccccgtgtcgtaatatacga

SEQ ID NO: 38683 - protein, 116 aa, Zea mays
  misc_feature: Ceres CLONE 1427634-F
  misc_feature (56)..(117): Pfam Name: PP-binding Pfam Description: Phosphopantetheine attachment site
  misc_feature: SWISSPROT Homolog: EC 6.1.1.13 D-alanine--poly(phosphoribitol) ligase
MASIAGSSALSFARPVKAINTNSLAFSPARKGNTFLRLQPMPMRSVSCAAKKDTTDKVCEIVKKQLALPDHTEVCGESKFSELGADSLDTVEIVMSLEEHFDISVEESSAQNNRTV

SEQ ID NO: 38684 - DNA, 745 bp, Zea mays
  misc_feature: Ceres CLONE 1427650-F
  misc_feature: Translation starting site: 275
aaagctggagctccccgcggtggcggccgctctagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcagggtctacacatggatagaaatgattactacggaggagattccacctccctaaacctgaaccagctctggaaaaagtttaggggggaagaacagccacgggacattctagtgcaagccaaaattacatggagacctgggttcaaagttaatgatggaaacgggaactttggttccccctcccttcccccggattgggaaaaaattttgtcattcaaaggttttatgggagactttttttttacaaaccggaaaattccaagggtccccgccccccattggagggcccaaaaaccccttggggggggttttttaaaaaacggaaaaggggattcttttttgttcccccaaaatcaaagaagcgttctcccgccccccaagggggggg

SEQ ID NO: 38685 - DNA, 741 bp, Zea mays
  misc_feature: Ceres CLONE 1427652-F
  misc_feature: Encodes the peptide sequence at SEQ ID NO. 38686
  misc_feature (599)..(599): n is a, c, t, g, unknown, or other
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttccctgctcgcttctcgacgggcgggcaggcacgggcaccttcnggctgacnggcgtgtcggtgtgggaagcgctggtgctggagatcgtgatgactttcgggctggtgtacacgtgtacgccacggcggtggaccccaagaaggcagcctgggcccatcggccccattgcatccggctcatcggg

SEQ ID NO: 38686 - protein, 134 aa, Zea mays
  misc_feature: Ceres CLONE 1427652-F
  misc_feature (13)..(135): Pfam Name: MIP Pfam Description: Major intrinsic protein
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFPARFSTGGQARAPSG

SEQ ID NO: 38687 - DNA, 674 bp, Zea mays
  misc_feature: Ceres CLONE 1427656-F
  misc_feature: Encodes the peptide sequence at SEQ ID NO. 38688
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgccccacgccacctacgggcagcagcagcagcagggaagaaggcgcgcgcccatgggtgagcaggtgaagggcatgctccacgaacaggggccgacggcctcccaggcgctgacggtggtgaccctgttcccgctgggcgggctgctgctggtnctttccgggctgggcctcaacgcctccggggtggggctggccctggcccccccgggtttcctgaatttagccccgtgctcctccccgccccgctgctcattggggacggcggtaatggggttccctcaacgtcgggcgcgctggggctcgggggccctttcctccctcacgtgccccaccaaaagggggcgggaaggggttccaccccacccccggaattacgtggaggaggcccccccccaagaatggcggaagcccccgcccaacccgggcaacaaa

SEQ ID NO: 38688 - protein, 127 aa, Zea mays
  misc_feature: Ceres CLONE 1427656-F
  misc_feature (15)..(127): Pfam Name: Oleosin Pfam Description: Oleosin
MGEQVKGMLHEQGPTASQALTVVTLFPLGGLLLVLSGLGLNASGVGLALAPPGFLNLAPCSSPPRCSLGTAVMGFPQRRARWGSGALSSLTCPTKRGREGVPPHPRNYVEEAPPQEWRKPPPNPGNK

SEQ ID NO: 38689 - DNA, 628 bp, Zea mays
  misc_feature: Ceres CLONE 1427662-F
  misc_feature: Encodes the peptide sequence at SEQ ID NO. 38690
  misc_feature (384)..(384): n is a, c, t, g, unknown, or other
  misc_feature (419)..(419): n is a, c, t, g, unknown, or other
  misc_feature (437)..(437): n is a, c, t, g, unknown, or other
  misc_feature (438)..(438): n is a, c, t, g, unknown, or other
  misc_feature (444)..(444): n is a, c, t, g, unknown, or other
  misc_feature (446)..(446): n is a, c, t, g, unknown, or other
  misc_feature (448)..(448): n is a, c, t, g, unknown, or other
ggagctccccgcggtggcggccgctctagaactagtggatcccccgggctgcaggaattcgcacgagaccattacctagaacatcctaatcgaaaaacattcctaaagtttgtgtccgcaatgatccaaagtccaccaaaccgagatcatgtggaggatcatcaatcatttgatctggaagattggcttccaataacagcatcaagaaatgcaaattggtactattcagctttccacaacgtaactgcaatggttggtgctggagttcttggccttccctacgccatgtcagagcttggatggggacctggggttgcggtgctgatcctgtcatgggtgatcacgttgtacaccctctggcaatgattgagatgcacgagatgnttgaagggcaacggtttgataggtaccacgagctnggtcaagcagccttgaanngagctngntngtaatcatcgtgcgctacagcttcttgtgaaaccgtgcggcattatctatttgggaccggaggtgatcgtttaaaaagttcatcactttctggggaaaatgacaggccccaagctaaaaaccaaaactccctttggaatttcccccctccaattttgggcccccccctcaaaaaactcac

SEQ ID NO: 38690 - protein, 81 aa, Zea mays
  misc_feature: Ceres CLONE 1427662-F
MIQSPPNRDHVEDHQSFDLEDWLPITASRNANWYYSAFHNVTAMVGAGVLGLPYAMSELGWGPGVAVLILSWVITLYTLWQ

SEQ ID NO: 38691 - DNA, 668 bp, Zea mays
  misc_feature: Ceres CLONE 1427666-F
  misc_feature: Encodes the peptide sequence at SEQ ID NO. 38692
aaagctggagctccccgcggtggcggccgctctagaactagtggatcccccgggctgcaggaattcgcacgagaccattacctagaacatcctaatcgaaaattcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgaggcgctcgacaaccctcgccgccgtctcatggttctacggatggaactcccacccccaaactttatgcagaaccctcagctgcaggagtttgaattccagaactttccgacttcttacctccgctgtgctgctcatcgtgttccacaactttatggcttaaagactatagtaccaaatattttagtaaaaggctccgttagcacgatttgttgaagaaaaaccgcgaaaggcgggactctcgcatttttttttcaagagtccctagccatcaagcaaaaattgctcttaaaccgcctaaaat

SEQ ID NO: 38692 - protein, 115 aa, Zea mays
  misc_feature: Ceres CLONE 1427666-F
MSTSPAAADVSPLPPTAAADEAARATETVVVDERVASHVDPFLVEALDNPRRRLMVLRMELPPPNFMQNPQLQEFEFQNFPTSYLRCAAHRVPQLYGLKTIVPNILVKGSVSTIC

SEQ ID NO: 38693 - DNA, 642 bp, Zea mays
  misc_feature: Ceres CLONE 1427674-F
  misc_feature: Encodes the peptide sequence at SEQ ID NO. 38694
  misc_feature (642)..(642): n is a, c, t, g, unknown, or other
ctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttctn

SEQ ID NO: 38694 - protein, 140 aa, Zea mays
  misc_feature: Ceres CLONE 1427674-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVF

SEQ ID NO: 38695 - DNA, 727 bp, Zea mays
  misc_feature: Ceres CLONE 1427678-F
  misc_feature: Encodes the peptide sequence at SEQ ID NO. 38696
  misc_feature (344)..(344): n is a, c, t, g, unknown, or other
  misc_feature (445)..(445): n is a, c, t, g, unknown, or other
  misc_feature (454)..(454): n is a, c, t, g, unknown, or other
  misc_feature (455)..(455): n is a, c, t, g, unknown, or other
  misc_feature (458)..(458): n is a, c, t, g, unknown, or other
  misc_feature (462)..(462): n is a, c, t, g, unknown, or other
  misc_feature (463)..(463): n is a, c, t, g, unknown, or other
  misc_feature (469)..(469): n is a, c, t, g, unknown, or other
  misc_feature (653)..(653): n is a, c, t, g, unknown, or other
  misc_feature (660)..(660): n is a, c, t, g, unknown, or other
aaagctggagctccccgcggtggcggccgctctagaactagtggatcccccgggctgcaggaattcgcacgagaccattacctagaacatcctaatcgaaaagtgctctctcagaggtgggctggcttctcctccccctcttatcaagtcctcctcgggttagggttccttagggttttgtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtccccgcgcttcngcttcgttaccttctcctccgagaactccatgctcgacgctatcgagaacatgaaacggcaggagctcgacggccgtaacatcaccgttaaccaggcccantccccttgnncgncgcnngcggcngcggcggcggtggttacgggggcgggtcccggcggcgggggctatgggggcgggggcccctacaccgcggttaaggcggcggggggctttacgggggtccggccaaaggggggggggggggcgcaaacggagcggggggggtttcccggctccccccaagggggtggggggggggtttaaaaangcggggnggggcccttagggaaaaaaatattttgccccccccccgggtgtttggggaggatatttttttttttt

SEQ ID NO: 38696 - protein, 152 aa, Zea mays
  misc_feature: Ceres CLONE 1427678-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (52)..(52): Xaa is any aa, unknown, or other
  misc_feature (85)..(85): Xaa is any aa, unknown, or other
  misc_feature (88)..(88): Xaa is any aa, unknown, or other
  misc_feature (89)..(89): Xaa is any aa, unknown, or other
  misc_feature (90)..(90): Xaa is any aa, unknown, or other
  misc_feature (91)..(91): Xaa is any aa, unknown, or other
MAAADVEYRCFVGGLAWATSNESLENAFASYGEILDSKVITDRETGRSPRFXFVTFSSENSMLDAIENMKRQELDGRNITVNQAXSPXXXXAAAAAVVTGAGPGGGGYGGGGPYTAVKAAGGFTGVRPKGGGGAQTERGGFPGSPQGGGGGV

SEQ ID NO: 38697 - DNA, 679 bp, Zea mays
  misc_feature: Ceres CLONE 1427690-F
  misc_feature: Encodes the peptide sequence at SEQ ID NO. 38698
  misc_feature (607)..(607): n is a, c, t, g, unknown, or other
  misc_feature (608)..(608): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaagtcagtcctcacaccacgcatctgattctgatcgcaccgccgtcggcccaccgcttcagttggcagttgcgagtggctccaacaatccaccggcaccaacccagcgcggcgccaccggcgacccgtaccccctcccccggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgccaaggacgaggccgacgtctccggggacctctccgggctcaccgacaaggagctcggcgtcctcgccgactgcgagatcaagttccaggccaagtaccccgtcgtcgcccgactcgcccgcgacgcctgaactcgtcagtctcggtctaaatttactctgtcctgccctctgcnngtgtcagtgctgtgcttgcttgctgtgtgctagttgctttgctacccnaatatctgaatggaaggacgtat

SEQ ID NO: 38698 - protein, 143 aa, Zea mays
  misc_feature: Ceres CLONE 1427690-F
  misc_feature (4)..(119): Pfam Name: Cyt-b5 Pfam Description: Cytochrome b5-like Heme/Steroid binding domain
  misc_feature (120)..(120): Xaa is any aa, unknown, or other
  misc_feature (136)..(136): Xaa is any aa, unknown, or other
MATELTAAQLRAYDGTDPSKPIYVSVRGKVYDVTSGRGFYGPGGAYAVFAGREASRALGKMPRTRPTSPGTSPGSPTRSSASSPTARSSSRPSTPSSPDSPATPELVSLGLNLLCPALCXCQCCACLLCASCFATXISEWKDV

SEQ ID NO: 38699 - DNA, 670 bp, Zea mays
  misc_feature: Ceres CLONE 1427691-F
  misc_feature: Encodes the peptide sequence at SEQ ID NO. 38700
  misc_feature (505)..(505): n is a, c, t, g, unknown, or other
  misc_feature (584)..(584): n is a, c, t, g, unknown, or other
aagctggagctccccgcggtggcggccgctctagaactagtggatcccccgggctgcaggaattcgcacgagaccattacctagaacatcctaatcgaaaactctctcacacggtcacaccctgacctcccccctccccctcccagaaaagacccctcgaaaaacggcggcgctgcgacatggcggaggtcgaggctccagctactgcggtcgaggctccagctgctgcggtcgcgacgacgacccctgaggtggcggcgcccgaggccggagccgctacggaggcgaagggtccgcacaagcttcaccggcagtggaccttctggtacgacatccagacgaagaccaagtccggggctgcgtggggcacctccctcaagaaggctacaccttcgacaccgttgagggagtctggagcatgtatgatcagatttttcgtccaagcaagttgtctgggaatgctgattttcatctattcaaggctggagtagagccaaaatggggngacccagagtgtgcaaatggtgggcaatggactgtcccatgcaacagaaaggcaacctttgagaccatgtggctggaancggtgatggctcttattggggagcagtttgatgaaacagaggacatttgtggaatttgtgctagtgccctgcaagaagaaatagct

SEQ ID NO: 38700 - protein, 84 aa, Zea mays
  misc_feature: Ceres CLONE 1427691-F
  misc_feature (1)..(83): Pfam Name: IF4E Pfam Description: Eukaryotic initiation factor 4E
  misc_feature (56)..(56): Xaa is any aa, unknown, or other
MYDQIFRPSKLSGNADFHLFKAGVEPKWGDPECANGGQWTVPCNRKATFETMWLEXVMALIGEQFDETEDICGICASALQEEIA

SEQ ID NO: 38701 - DNA, 675 bp, Zea mays
  misc_feature: Ceres CLONE 1427692-F
  misc_feature: Encodes the peptide sequence at SEQ ID NO. 38702
  misc_feature (424)..(424): n is a, c, t, g, unknown, or other
  misc_feature (425)..(425): n is a, c, t, g, unknown, or other
  misc_feature (439)..(439): n is a, c, t, g, unknown, or other
  misc_feature (542)..(542): n is a, c, t, g, unknown, or other
  misc_feature (592)..(592): n is a, c, t, g, unknown, or other
aagctggagctccccgcggtggcggccgctctagaactagtggatcccccgggctgcaggaattcgcacgagaccattacctagaacatcctaatcgaaaagaaagcaaaaaccaaccaaacaagctagctagagctagccaagccgcggcgtgcctccgctccggccggcccgcccctgtcagagcccccaccgccgctgccacctccgccagccgtcaccccaggcgttggatcggggccctctcgatccgcgcccggcgaatccagacggacccgcattggggttggggccccttcgatccggcgcttggtgggggtttggctgggagctccaggctgaggggacggggcggggggacctgatccttcattccgttcggatttcgcttttcccccgtggggtctcgactgccggagggggnnggagacatggattngcgtcggtcaacgaggagctggccgagatcgacgggcagatcggcgatatcctccgcgtattgcaaaaatggttccagaagctggagaagatcaaggatgccnacccgcgcagcaggcagctttgagagcttactgataagatgcgagactgncagagactcatcaaagacttcgagcgagttagcaaagctgaggctgagcatactgatccagcaacagcaaaaatgttgcatga

SEQ ID NO: 38702 - protein, 31 aa, Zea mays
  misc_feature: Ceres CLONE 1427692-F
  misc_feature (4)..(4): Xaa is any aa, unknown, or other
MRDXQRLIKDFERVSKAEAEHTDPATAKMLH

SEQ ID NO: 38703 - DNA, 680 bp, Zea mays
  misc_feature: Ceres CLONE 1427695-F
  misc_feature: Encodes the peptide sequence at SEQ ID NO. 38704
ccatgctggagctcaccgcggtggcggccgctctagactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcactggtgagactgaggagttcttcacttcatatgatgaagtttttgagagttttgatgatatgggcctccaagagaatcttctgagaggcatttatgcttatgggtttgagaagccctctgcaattcagccgagaggaattgttccccttctgcaagggtcttgatgtcattcagccaagccgatctggtacaggaaaaaacggaacccttctgttcttgggatccttgcacagcttggctaatggcccgggtgaaatggccaggccctgggcccttggctcccaccccgtgaggctttccccaggaaaatttgagaaaagtccttgccgggcgccttgggtgaaatacccttgggcggttaaag

SEQ ID NO: 38704 - protein, 79 aa, Zea mays
  misc_feature: Ceres CLONE 1427695-F
MAGMAPEGSQFDAKHYDSKMQELLSTGETEEFFTSYDEVFESFDDMGLQENLLRGIYAYGFEKPSAIQPRGIVPLLQGS

SEQ ID NO: 38705 - DNA, 685 bp, Zea mays
  misc_feature: Ceres CLONE 1427697-F
  misc_feature: Encodes the peptide sequence at SEQ ID NO. 38706
  misc_feature (543)..(543): n is a, c, t, g, unknown, or other
aaagctggagctccccgcggtggcggccgctctagaactagtggatcccccgggctgcaggaattcgcacgagaccattacctagaacatcataatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaaaggcgtggcaagaatcaggagagagatagcaggggggctagctagctgagctcgtgcgacgaagaatgcccggaattgcaggaacatggtggcgccgctcctggtgctcaacctcatcatgtacatcatcgtcatcggcttcgcgagctggaacctgaacactttcatcacgggcagaacaactacccccggcgtggccggcaccggcccgactttctactttcttggtgtccgcattcctggcccggcggggtgggcgcggccntccaagctgggcgggcgtgcaccacgtggcggcccttggcccaacgacaacctggccaccaaacgccggcgtcgttccttatcgccgtgggcaatcagggccctccccttcggggtggccctgaaagaaaatccccttcggg

SEQ ID NO: 38706 - protein, 107 aa, Zea mays
  misc_feature: Ceres CLONE 1427697-F
  misc_feature (7)..(107): Pfam Name: AWPM-19 Pfam Description: AWPM-19-like family
MVAPLLVLNLIMYIIVIGFASWNLNTFITGRTTTPGVAGTGPTFYFLGVRIPGPAGWARPSKLGGRAPRGGPWPNDNLATKRRRRSLSPWAIRALPFGVALKENPLR

SEQ ID NO: 38707 - DNA, 718 bp, Zea mays
  misc_feature: Ceres CLONE 1427707-F
  misc_feature: Encodes the peptide sequence at SEQ ID NO. 38708
aagctggagctccccgcggtggcggccgctctagaactagtggatcccccgggctgcaggaattcgcacgagaccattacctagaacatcctaatcgaaaaaccaaaggtatcttgcaatcacaacgaacaaaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaagaggacgagctcctggccctgatcgagaagcatgccgcgcctgcgcctgcggctgcgtctgcctaaagagatcagatcagtcgtcgccgtcaataagggccagcacgtatggctgtagatgttggccttatcagttctggctttgtcctttgtgggcgattgtgaactagtaggatgtttgtttctatccaattcggaggcgatacttacccaaaaaaaaaaaaaaaagcttatcatcccgccaa

SEQ ID NO: 38708 - protein, 107 aa, Zea mays
  misc_feature: Ceres CLONE 1427707-F
  misc_feature (8)..(102): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVDVDEVKEVTAAYEVEAMPTFHFVKNGKTVATIVGAKRTSSWP

SEQ ID NO: 38709 - DNA, 665 bp, Zea mays
  misc_feature: Ceres CLONE 1427708-F
  misc_feature: Encodes the peptide sequence at SEQ ID NO. 38710
  misc_feature (468)..(468): n is a, c, t, g, unknown, or other
aagctggagctccccgcggtggcggccgctctagaactagtggatcccccgggctgcaggaattcgcacgagaccattacctagaacatcctaatcgaaaaaaaaatagcaaatttctcggcttccgccacacccgctccaggtcccctcccccaaactgaaacgaagttgcggcggtcgcgactgagtgcagagatgctgcagttcccggcgctgatgcggcagtggccatcgccggcgctgatcccggcgtccacgctgctccccgtgccggccacctcccaggaggacgagcttctcctctcccatggcgagtccgacctcgagggatagctgaacgagatccggaaaacaacagccacctggttatcatcgggaagcccacgggcgacaccaaggaggagtacgacgctgaggtggaggacgacgatgcagacaacgtcgaggagtctgacggcgactacttcnaccaggaaccggttgacccaggtgggctccccgtgcttcgtcggcgtccttgagcgtcgtcatccccgctgtccagtctgtatttcgcaatccctgagttgctccttctatctagatacgctgttaccctattttgctgctgtctgttctcaggatctgagcatgtccctgtcgtgtggaccttgtggataaaacaa

SEQ ID NO: 38710 - protein, 45 aa, Zea mays
  misc_feature: Ceres CLONE 1427708-F
MLQFPALMRQWPSPALIPASTLLPVPATSQEDELLLSHGESDLEG

SEQ ID NO: 38711 - DNA, 617 bp, Zea mays
  misc_feature: Ceres CLONE 1427717-F
  misc_feature: Encodes the peptide sequence at SEQ ID NO. 38712
  misc_feature (527)..(527): n is a, c, t, g, unknown, or other
  misc_feature (549)..(549): n is a, c, t, g, unknown, or other
  misc_feature (565)..(565): n is a, c, t, g, unknown, or other
  misc_feature (566)..(566): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (588)..(588): n is a, c, t, g, unknown, or other
  misc_feature (589)..(589): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (605)..(605): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
aaagctggagctccccgcggtggcggccgctctagaactagtggatcccccgggctgcaggaattcgcacgagaccattacctagaacatcctaatcgaaaatctcccgcagagcagccgacaactctctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcaggccgacgaggatccagcttacgggaaaatcaggcctccctgcttaaaaattgccaggggcaggaaatgtcccccccaaaatttttggggggggtgaaaaattttccccccccccgagaaaatagtnggggggcccgccccccgcccanaaaaaaaagaaagagnnagnnnnnnnnnnnnnnnnncanntgccctccaccnnncnccnnnnaacccc

SEQ ID NO: 38712 - protein, 105 aa, Zea mays
  misc_feature: Ceres CLONE 1427717-F
  misc_feature (11)..(99): Pfam Name: Ribosomal_S3Ae Pfam Description: Ribosomal S3Ae family
MAVGKNKRISKGKKGGKKKTVDPFSKKDWYDIKAPSVFSVRNIGKTLVSRTQGTRIASEGLKHRVFEVCLADLQADEDPAYGKIRPPCLKIARGRKCPPQNFWGG

SEQ ID NO: 38713 - DNA, 667 bp, Zea mays
  misc_feature: Ceres CLONE 1427731-F
  misc_feature: Encodes the peptide sequence at SEQ ID NO. 38714
  misc_feature (304)..(304): n is a, c, t, g, unknown, or other
  misc_feature (376)..(376): n is a, c, t, g, unknown, or other
  misc_feature (394)..(394): n is a, c, t, g, unknown, or other
  misc_feature (426)..(426): n is a, c, t, g, unknown, or other
  misc_feature (438)..(438): n is a, c, t, g, unknown, or other
  misc_feature (445)..(445): n is a, c, t, g, unknown, or other
  misc_feature (446)..(446): n is a, c, t, g, unknown, or other
  misc_feature (460)..(460): n is a, c, t, g, unknown, or other
aagctggagctccccgcggtggcggccgctctagaactagtggatcccccgggctgcaggaattcgcacgagaccattacctagaacatcctaatcgaaaaattagttcagcacagcacatcttcctcgcagcgccggcgctccatcttccgctccctcccccaccttcgatcggcacgcaggctcggcgtcgtcgtcagcggttcctcctcccgcctctcgccagtagcctcgcgccctcgccgactggcgaccctgccttgaaggggctggcaagatgatcggcgtagggaaggcgaagcantacgccaacgtccttgacaagcccctcagccgtggcaggcaggaggtcagtttgagtgcatttgcattcttngtctctgagtgggttcantacaaccaggactcagttgaacacattactgnagctgaaacgangctgganngatgctgttatgcntgtgggtgcagggtgcttgaactactctgtcacagggagaagggaaatagacgagagacacgacttctgggcattttatcattcatcacagtactgtttggaaatggttgttagaaagggtgctgactccctggaaaagggacagaacacgaggatgaatcctgatcggggaaaggagcttcctgataaccgtttcttttctgtgca

SEQ ID NO: 38714 - protein, 98 aa, Zea mays
  misc_feature: Ceres CLONE 1427731-F
  misc_feature (9)..(9): Xaa is any aa, unknown, or other
  misc_feature (33)..(33): Xaa is any aa, unknown, or other
  misc_feature (39)..(39): Xaa is any aa, unknown, or other
  misc_feature (50)..(50): Xaa is any aa, unknown, or other
  misc_feature (54)..(54): Xaa is any aa, unknown, or other
  misc_feature (56)..(56): Xaa is any aa, unknown, or other
  misc_feature (57)..(57): Xaa is any aa, unknown, or other
MIGVGKAKXYANVLDKPLSRGRQEVSLSAFAFXVSEWVXYNQDSVEHITXAETXLXXCCYACGCRVLELLCHREKGNRRETRLLGILSFITVLFGNGC

SEQ ID NO: 38715 - DNA, 829 bp, Zea mays
  misc_feature: Ceres CLONE 1427734-R
  misc_feature: Encodes the peptide sequence at SEQ ID NO. 38716
  misc_feature (541)..(541): n is a, c, t, g, unknown, or other
tgctttatttcaccgtctgacgcgatatacagaaatacaacgagtgtcaaaacagtagtaaaacatcacaagtctaaaaacgacgtgttctccagcgacaacagtgggctggactggacacaatcggcagggaaatgtacgtcgaaatcaacagaaggcacccgagctttatttttctgtgatggaaatgatgaacgtctcaggaaatagtttgccagaagcccagaactgtgtgctctagggctcgaccaccatgctctccgcttccttcttgatggactggaacagcaccgaggagaggtagcgctcgccgaagctcgggaacacgacaacaaatagctttccggcgttttctggcctcttagcaagcctaactgccgcagctgcagctgcaccagaagagattccaaccaacaacccttctttcagagcaagagccttggcagtctcgatagcttcatcacttgaaacttgtagagtttcatcaaggagatcaacatccaagactccagggataaaaccagctccaattccttgaatnctgtgtggtcccaggttttcaccattcaaaacagcactctccactggctccacaccatagagcttgacattaggattttgctctctgaagtatcgcccagtacccggtgatgggtacctcctgttccgataccagatacaaggccatcattttttccctgctgtagcttttccagatttcaggccccgtaagcccatagtgaatcctttgggttagctggatttttcaaattgttgaaaggagtaaaaaaatggggggggccttggcctgtatacccttccggctttt

SEQ ID NO: 38716 - protein, 69 aa, Zea mays
  misc_feature: Ceres CLONE 1427734-R
CFISPSDAIYRNTTSVKTVVKHHKSKNDVFSSDNSGLDWTQSAGKCTSKSTEGTRALFFCDGNDERLRK

SEQ ID NO: 38717 - DNA, 829 bp, Zea mays; identical to SEQ ID NO: 38715
  misc_feature: Ceres CLONE 1427734-R2
  misc_feature: SWISSPROT Homolog: EC 2.5.1.47 Cysteine synthase
  misc_feature (541)..(541): n is a, c, t, g, unknown, or other

SEQ ID NO: 38718 - DNA, 619 bp, Zea mays
  misc_feature: Ceres CLONE 1427734-F
  misc_feature: Encodes the peptide sequence at SEQ ID NO. 38719
ccccgcggtggcggccgctctagaactagtggatcccccgggctgcaggaattcgcacgagaccattacctagaacatcctaatcgaaaaataacccgctctggatcaaagtgcactcagctattcgagtacccggaacgataagattgtttccatcggatctccggcgcggctcgatgcattgcctcacgattgcatctctatggtgatttattgcacctctccccgcggtgcctgcgtcgggccttcagtttcgaaaactgatcaatcggcggctgaatcgcatctggcttgggagaagtttcttcctcaggactactcatctcttgttccacctcgatctgaggatttctcgttgaagaaggagatgtatgtgtctctccccgattattccgctctgatccactaccgcaaaactacttttcggttggagaaatgtactggaaagaagtctcacttgttatctgcgatggatttaaatatcctttgcatgaatcgtcctgcgtattggaaatggaatacacatcccgaatctgggtttgagaaagtagcgtacctacgcccccgtgtgttggttacaggattcgccgccaagataaggctgtggaaacgttgtcca

SEQ ID NO: 38719 - protein, 139 aa, Zea mays
  misc_feature: Ceres CLONE 1427734-F
MVIYCTSPRGACVGPSVSKTDQSAAESHLAWEKFLPQDYSSLVPPRSEDFSLKKEMYVSLPDYSALIHYRKTTFRLEKCTGKKSHLLSAMDLNILCMNRPAYWKWNTHPESGFEKVAYLRPRVLVTGFAAKIRLWKRCP

SEQ ID NO: 38720 - DNA, 670 bp, Zea mays
  misc_feature: Ceres CLONE 1427736-F
  misc_feature: Encodes the peptide sequence at SEQ ID NO. 38721
  misc_feature (362)..(362): n is a, c, t, g, unknown, or other
  misc_feature (509)..(509): n is a, c, t, g, unknown, or other
  misc_feature (563)..(563): n is a, c, t, g, unknown, or other
  misc_feature (610)..(610): n is a, c, t, g, unknown, or other
  misc_feature (617)..(617): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgnagtcgtcgtcgctaaggagccggagcccgtggaagccgaaactgagactgagaccaagaggccgaaggcgttgctgagccgaccgagcagagcccaagaagcagagccggagcccgcgcgccggcagcagagacggaggtcaagaangcagaagacgaggccgccgcgccggcagcagagacggaggctgctgctgccccngtcgaagctgctgagcccgaaatagccgcgaagacaaaaggagtgcngctgtgnnggctaaccaggaggagggagaggccccccctgctgttgctgccactcctgag

SEQ ID NO: 38721 - protein, 115 aa, Zea mays
  misc_feature: Ceres CLONE 1427736-F
  misc_feature (41)..(41): Xaa is any aa, unknown, or other
  misc_feature (90)..(90): Xaa is any aa, unknown, or other
  misc_feature (108)..(108): Xaa is any aa, unknown, or other
MAAVEVQVPTAAPVEEAAQLAAASAVETPNEETAAPAVETXVVVAKEPEPVEAETETETKRPKALLSRPSRAQEAEPEPARRQQRRRSRXQKTRPPRRQQRRRLLLPXSKLLSPK

SEQ ID NO: 38722 - DNA, 797 bp, Zea mays
  misc_feature: Ceres CLONE 1427737-F
  misc_feature: Encodes the peptide sequence at SEQ ID NO. 38723
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
naaaannnnnnaaaannnnaaaaaggaannnangannnnnnnntgacgggtaaataaaccaaactgggactccccgcggtggcggccgctctagactagtggatcccccgggctgcaggaattcgcacgagaccatacctagaacatcctaatcgaaaacccatttcgaagcccaccgaattccctgcgattcctctcccctcggctcctcgtctccccctaggggatcgtcggagaggaatcgcaaagagggccgtctcatccgagttaaggaagccatggagcacagggaggctgggtgccaggcccccgagggacccatcctctgcatcaatatcggtggcttccttgggaggcgcggggaccattaacatgtactcgaaagtggcacaaggaaatgacaaaggaagggggttcaaggcaaaaccgggcttggctcccccttgtgcgccggcttcaagggaaggagggacggacccccctacatgggaagcccggggtgttaggttggggaacgaaagagggggtctgggtgcttctgggggccgctacattcaagatttccaagaaaaaaaataacgcgggcgtcaaacgccccaccgttaggggggggcggggaacccacaccaaaagggagaacccccctcacacttcccaaaaaggggggggaaagggggaacaccccctaaaacgtgtggtgcacccccctcggcgtaaaaaaggggggggggggacctttcgggggttcttcctcgctcccccatgggtggaaacttttgtcctgcccctcgccctcg

SEQ ID NO: 38723 - protein, 30 aa, Zea mays
  misc_feature: Ceres CLONE 1427737-F
MEHREAGCQAPEGPILCINIGGFLGRRGDH

SEQ ID NO: 38724 - DNA, 754 bp, Zea mays
  misc_feature: Ceres CLONE 1427738-F
  misc_feature: SWISSPROT Homolog: EC 6.6.1.1 Magnesium chelatase
  misc_feature (467)..(467): n is a, c, t, g, unknown, or other
ggagctccccgcggtggcggccgctctagaactagtggatcccccgggctgcaggaattcgcacgagaccattacctagaacatcctaatcgaaaagccaaggaaacagtcacgtctcccaaatctaactgccccccgactcacgaatacccaaagcctccatggagacgcaccgccactgactcccactcctcctcctcgtggccgccgccctcgccgccgtccctgctcgatgcggcgctggtcggtgggcgcgacccgctgctggtctgttggaaccctatccctgacgtgagcgactcgcacatccctcagctaggcgggtgggccctcgggcatgctaaccaccagaatctggcctcccactggctgcggatccaccgcatgtatccctgtaaccatgtctcttgttgaatgtgattgatcccaagatcggtggtgtgatgataatgggagacagaagaacngagaatccacaaccggccggtccttaatcaatctctaccccaaattacgggagttggaggcgacccttacatctttgacccgttaaaccctagattctgggggtttaaggtaaaaaaaaaatcaaaaaaggaaagaaaggttcccctttttccccccaaagaaaaaagtggttaaccttcccccagggggacacctaaaaaaagaaatttggggaaactctccatatccaaaaagggtttaaaaaagagggggcaaaactcttttatacccctcccttgtttctaaa

SEQ ID NO: 38725 - DNA, 665 bp, Zea mays
  misc_feature: Ceres CLONE 1427746-F
  misc_feature (409)..(409): n is a, c, t, g, unknown, or other
  misc_feature (459)..(459): n is a, c, t, g, unknown, or other
  misc_feature (513)..(513): n is a, c, t, g, unknown, or other
  misc_feature (529)..(529): n is a, c, t, g, unknown, or other
  misc_feature (539)..(539): n is a, c, t, g, unknown, or other
  misc_feature (545)..(545): n is a, c, t, g, unknown, or other
  misc_feature (551)..(551): n is a, c, t, g, unknown, or other
  misc_feature (554)..(554): n is a, c, t, g, unknown, or other
  misc_feature (558)..(558): n is a, c, t, g, unknown, or other
aaagctggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagancgagcgcgtgttccgcaagttcgacgcgaacggcgacgggcagatctcgncgtccgagctggcggcgctgttcgagggcgtgggccacgccgtgaccgaccacnagtgttcccagatggnaaagaggcgnacccgnaaggcnacngctncatcaccctggccgagttcgcccgcttcatggagtccggtcccgcccacccccccccgttcaggagacccgccccaccctttatgttcttcaaccccaagggaaccg

SEQ ID NO: 38726 - DNA, 663 bp, Zea mays
  misc_feature: Ceres CLONE 1427751-F
  misc_feature (402)..(402): n is a, c, t, g, unknown, or other
  misc_feature (411)..(411): n is a, c, t, g, unknown, or other
  misc_feature (441)..(441): n is a, c, t, g, unknown, or other
  misc_feature (452)..(452): n is a, c, t, g, unknown, or other
  misc_feature (456)..(456): n is a, c, t, g, unknown, or other
  misc_feature (476)..(476): n is a, c, t, g, unknown, or other
  misc_feature (477)..(477): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcgaaaaatgagtccgcgcccacggccgaggcagctgcaggcagcggcccggccggcggagaagggcggaagggcaaggcgcccaagggcgggcccgagaacggcaagttccggtaccgcggcgtgcggcagcggagttggggcaagtgggtggcggaaatccgcgagccgcggaagcgctcccgcaagtggctcggcaccttcgccacccgcgagggacgcgcgcgcgcctacgaccgcgccgcgctcctcctctacggcccccgcgcgcacctcaacctcacgtcgcgcggccgcgctacgctcngcgcgccgngctcgcacccggactcctccctcgcacgtngtctgccccgncagngctccgcccgctccctgcgnngcccgcactggcacagctctccagcgacggtgctccctgcacggatttcactaccacaatcagtttcagcggcgtctcttgccgcagccgacacccacactatactacgccaacccggccacggcgtccacagtgaccaccagtgtgccgacacgggtggcngtcccgcaggagccggccatcgcc

SEQ ID NO: 38727 - DNA, 679 bp, Zea mays
  misc_feature: Ceres CLONE 1427753-F
  misc_feature: Encodes the peptide sequence at SEQ ID NO. 38728
  misc_feature (391)..(391): n is a, c, t, g, unknown, or other
  misc_feature (403)..(403): n is a, c, t, g, unknown, or other
aaagctggagctccccgcggtggcggccgctctagaactagtggatcccccgggctgcaggaattcgcacgagaccattacctagaacatcctaatcgaaaaatcacataagtccgccgcccctctccctcagtaaacccccctctcttcttcccgcggtctgctcgttcgatctgtgcagcagatctgaggtctcgagcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctcccaacagacccctgagtttcttaagatgaaacccccttgggaagggtncctgttctgganactcctgatgggccctgtttttgagagtaatgctatcgcacgctatgttgctcgccagaaagatgacaaccctctttttgggtcttcccgtattgaacaagcccacgttgagcaatggatggattttgccgcaacagaagttgatcctggtggggcatggtacttgtatccaaggcttgggtacctccctatgtcagcacaactgaggaaaccgctatttcttcatgaagagggcccttggggctctgaaacacccccttcctaaacacatacctt

SEQ ID NO: 38728 - protein, 146 aa, Zea mays
  misc_feature: Ceres CLONE 1427753-F
  misc_feature (1)..(77): Pfam Name: GST_N Pfam Description: Glutathione S-transferase, N-terminal domain
  misc_feature: SWISSPROT Homolog: EC 2.5.1.18 Glutathione transferase
  misc_feature (55)..(55): Xaa is any aa, unknown, or other
  misc_feature (59)..(59): Xaa is any aa, unknown, or other
MALVLHSGAGNKNAFKALIAAEYSGIKVELTKDFEMGVSQQTPEFLKMKPPWEGXLFWXLLMGPVFESNAIARYVARQKDDNPLFGSSRIEQAHVEQWMDFAATEVDPGGAWYLYPRLGYLPMSAQLRKPLFLHEEGPWGSETPPS

SEQ ID NO: 38729 - DNA, 669 bp, Zea mays
  misc_feature: Ceres CLONE 1427760-F
  misc_feature: Translation starting site: 167
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaaacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaactgctgacgttctgttatggaaagacagaaaacttctgctgttgtaataggcggcgcaactgtcatctggggtctgttcgaagtgcttgattaccacctcctgaccctgatatcccatgtactgattgggtgtgcttgccaccnttatcctgtggtccaaagcaaccacgttcatcaagaagagtccaccggatattccagtagtgcaggtatctgaggaccttgttgtggatgtttcccgggcttacggaatgacatcacagagcgcttcactgttccgggagatcgcaatggg

SEQ ID NO: 38730 - DNA, 719 bp, Zea mays
  misc_feature: Ceres CLONE 1427764-F
  misc_feature: Translation starting site: 430
aagctggagctccccgcggtggcggccgctctagaactagtggatcccccgggctgcaggaattcgcacgagaccattacctagaacatcctaatcgaaaaatcataaaaaaaagacaccctgcgtcatttaccgaccaccgtccatccatggatgcagccgagggccgaggggcagagtgggccgaggggcgtggcaggcggtgagcacgccggtggtcgggacggtacggatctcgtgatccatggccttcgcgggatggcgctgctccctgcttatgacacctcccgttcaccggcagcgaatcggggcttggcatttcccatcaagcattaagcagtgaagcaccccccctcgtttccaccggcagtccggcagcgagcagacagtaacagaatcaggcggtgtcttggaaataacttcagtgccatggcctggtctcatggaacatctccattatttccagtttacaagcttgagcagatcctgatgcgaggaccctccatctgtgatactctcgcacgctgctctcttcaaagaaagtgccctcgctctgatcgtatcatcagcgagcagctggttgactttgtccctgatctcctccttggtgaagaccccccgctcgttggcaacgatctcaagcccgtgccccacccgcgcaaatgtacttctggttcaagaactggccggtaaatttggccaacccaggaacgggaccc

SEQ ID NO: 38731 - DNA, 624 bp, Zea mays
  misc_feature: Ceres CLONE 1427766-F
  misc_feature: SWISSPROT Homolog: EC 2.1.1.10 Homocysteine S-methyltransferase
  misc_feature (186)..(186): n is a, c, t, g, unknown, or other
  misc_feature (561)..(561): n is a, c, t, g, unknown, or other
aagctggagctccccgcggtggcggccgctctagaactagtggatcccccgggctgcaggaattcgcacgagaccattacctagaacatcctaatcgaaaaaaccctatcctagcacgagtgcacgacggtggcagcaggagatggtggggacggcggaaggcggcgcggagagggcggtgcggcngtgggtggaccccgccggcgggcgcctggtcctggacggggggctggcacggagctcgagccaacggggccaaacttcacgacccgcttttggacgccaattgtttccttttcttccggaacttttttcggaagggtcattttggattaccttagagccgggggcaaattttttatttcccggttcttttttgggcccctctcccgggggttttaattaaaaggtttttttcaaacaccccaagggaaaatttgtttaaaaaaagtgttttttaatttccccccccacccgccgggggagtttttttttagaaggaatttttgtgggaaaaacccccccctcttttttcgaattttttttttttttggtttgccncccctttcttgagggaggagtttggggggctttttttttttcttgtagggcttccccaggaaa

SEQ ID NO: 38732 - DNA, 677 bp, Zea mays
  misc_feature: Ceres CLONE 1427774-F
  misc_feature: Encodes the peptide sequence at SEQ ID NO. 38733
  misc_feature (536)..(536): n is a, c, t, g, unknown, or other
  misc_feature (584)..(584): n is a, c, t, g, unknown, or other
  misc_feature (585)..(585): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaaacatttcctctcccgataagagtgaggcctcggctaagcttgagcttcccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaagaggagcccgtatccctccgccccgctgcccgccggaccgatggactccgagcactggatctcgcgcctggccgccgcgaagcgcttctacgcggcgcagctcggccacagcgatcggggcggggatggacgagctggagatggacgaagaggtcaggcccgagttcccctgcccctactgctacgaggaccacgacgtcngatccctctgcgcgcacctggaggaagagcacccgttcgaaccccaanngcgcgnctgccctgtctgctcagagatggttacgaaggatatgggtaaccatattactaccgcacatggatatttattcaggaatcggcgcc

SEQ ID NO: 38733 - protein, 72 aa, Zea mays
  misc_feature: Ceres CLONE 1427774-F
  misc_feature (26)..(26): Xaa is any aa, unknown, or other
  misc_feature (42)..(42): Xaa is any aa, unknown, or other
  misc_feature (44)..(44): Xaa is any aa, unknown, or other
MDELEMDEEVRPEFPCPYCYEDHDVXSLCAHLEEEHPFEPQXRXCPVCSEMVTKDMGNHITTAHGYLFRNRR

SEQ ID NO: 38734 - DNA, 736 bp, Zea mays
  misc_feature: Ceres CLONE 1427778-F
  misc_feature: Encodes the peptide sequence at SEQ ID NO. 38735
aagctggagctccccgcggtggcggccgctctagaactagtggatcccccgggctgcaggaattcgcacgagaccattacctagaacatcctaatagaaaaagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggaggcggcagcggcggcggcggtggcggccaacggaaaggcgtgctgccacgccgccaaggggcccgggtacgccacgccgctggaggccatggagaagggccccagggagaagctcgtctacgtcacctgcgtctacaacggcaccggaattaacaagccggattaccttgcgacggtggatttggatcccagctctcctacgtactcccaggtgatccacaggctcccggtcacccacatcggcgacgagctgcatcactctggctggaactcctgcagctcctggcacggcgaacccatcgccaagcgccgctttctgatcctggctttcttgctgtcaggccgtgtg

SEQ ID NO: 38735 - protein, 124 aa, Zea mays
  misc_feature: Ceres CLONE 1427778-F
  misc_feature (25)..(124): Pfam Name: SBP56 Pfam Description: 56kDa selenium binding protein (SBP56)
MAGAAAVEAAAAAAVAANGKACCHAAKGPGYATPLEAMEKGPREKLVYVTCVYNGTGINKPDYLATVDLDPSSPTYSQVIHRLPVTHIGDELHHSGWNSCSSWHGEPIAKRRFLILAFLLSGRV

SEQ ID NO: 38736 - DNA, 667 bp, Zea mays
  misc_feature: Ceres CLONE 1427779-F
  misc_feature: Encodes the peptide sequence at SEQ ID NO. 38737
  misc_feature (549)..(549): n is a, c, t, g, unknown, or other
aaagctggagctccccgcggtggcggccgctctagaactagtggatcccccgggctgcaggaattcgcacgagaccattacctagagcatcctaatcgaaaactccacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaagaagcgcccgtggtggagaccccgcccgcggccgtcgtgcccgaagagtctgcccccgccgagccgaagcccgaggcgaagctgaggctgctgctcctgctgatcccgaagagcttccccgcgccgagcagcaggcagccgccgagcccgaagccgctgctccctgctgtgccgagaagcccgcggcggcgaatccgccgccgaggctgaggctgctgctcctgctggtcccgagaagactcccgcgccgagcangaagcagcccccgaggagaggctgctgctgctcctcctgctggggccaaagagccgcccgcgccgagccggtcgccgagggaaaagctcctgctcccaagaaactccccccgaacgaa

SEQ ID NO: 38737 - protein, 84 aa, Zea mays
  misc_feature: Ceres CLONE 1427779-F
MATAEVQTPTVVAAEEAPVVETPPAAVVPEESAPAEPKPEAKLRLLLLLIPKSFPAPSSRQPPSPKPLLPAVPRSPRRRIRRRG

SEQ ID NO: 38738 - DNA, 635 bp, Zea mays
  misc_feature: Ceres CLONE 1427782-F
  misc_feature: Encodes the peptide sequence at SEQ ID NO. 38739
aaagctggagctccccgcggtggcggccgctctagaactagtggatcccccgggctgcaggaattcgcacgagaccattacctagaacatcctaatcgaaaaagccttccccgtctctcctcttctgccgaacgagacagaccgggttatgtagcctgcctcgctttcggcgagagaggaagaggcggaggagatcagggcaatgggcggggcggaggcgctgggccagccggacggccatgcgaacggggccgtggtggaggagaagctggacttgctgcggcggcagctggggaaggcggacggcgacccgctccggatcgtcggcgtcggggcgggcgcctggggtagcgtcttctgcgcgctgctgcaggacgcgtaccgcccactccgcgacaaggcgcaggtccgcatctggcgccggccgggccgagccgtcgaccgcgccaccgccgaagacctcttcgacgtcatcaacgcgcgcgaggacgtcctgcgcccccctgatccgccgctgcccctacctaaagtaacgtcaaggggccccttgggcgaccggcccgcctctacccccaaccaagatactcgggggaagggcttttctggctccaaattggattcaacccccccccccc

SEQ ID NO: 38739 - protein, 144 aa, Zea mays
  misc_feature: Ceres CLONE 1427782-F
MGGAEALGQPDGHANGAVVEEKLDLLRRQLGKADGDPLRIVGVGAGAWGSVFCALLQDAYRPLRDKAQVRIWRRPGRAVDRATAEDLFDVINAREDVLRPPDPPLPLPKVTSRGPLGDRPASTPNQDTRGKGFSGSKLDSTPPP

SEQ ID NO: 38740 - DNA, 717 bp, Zea mays
  misc_feature: Ceres CLONE 1427783-F
  misc_feature: Translation starting site: 229
  misc_feature: SWISSPROT Homolog: EC 5.2.1.8 Peptidylprolyl isomerase
  misc_feature (408)..(408): n is a, c, t, g, unknown, or other
  misc_feature (409)..(409): n is a, c, t, g, unknown, or other
  misc_feature (458)..(458): n is a, c, t, g, unknown, or other
  misc_feature (487)..(487): n is a, c, t, g, unknown, or other
  misc_feature (493)..(493): n is a, c, t, g, unknown, or other
  misc_feature (494)..(494): n is a, c, t, g, unknown, or other
  misc_feature (499)..(499): n is a, c, t, g, unknown, or other
  misc_feature (501)..(501): n is a, c, t, g, unknown, or other
  misc_feature (502)..(502): n is a, c, t, g, unknown, or other
  misc_feature (509)..(509): n is a, c, t, g, unknown, or other
  misc_feature (515)..(515): n is a, c, t, g, unknown, or other
aaagctggagctccccgcggtggcggccgctctagaactagtggatcccccgggctgcaggaattcgcacgagaccattacctagaacatcctaatcgaaaacattaactagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttttcggctttcggtcaccttctccacggnnagagcgatgcggaacgccatcgagggcatgaacggcaaggagctggacngccgcaacatcaccgtcaacgaggcccantcccgnncgcgncnntgaagcngcggcngtgggtaccgtgggtgccgtggaggcgggcgctaccggcgtggcgggccccctgatggcgtggcggctaccggggtgcgggggttaacggggcggcgcggctaccggggtggggggggcggttcccgggggggaaacctggggggggggttttgggcactcccccaggggaattggggaaattgggcggggggccccccccc

SEQ ID NO: 38741 - DNA, 733 bp, Zea mays
  misc_feature: Ceres CLONE 1427789-F
  misc_feature: Translation starting site: 166
  misc_feature (446)..(446): n is a, c, t, g, unknown, or other
aagctggagctccccgcggtggcggccgctctagaactagtggatcccccgggctgcaggaattcgcacgagaccattacctagaacatcctaatcgaaaactaatcgaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcataaagagaaagggtgttgatgagttcccctactgtgtgcaccttgtctcttgggagagggagatgtctccagtgaggctcttgaggctgcccgtatggcctggcacaagtacatgaccaattctgcaagaaaggatgccttccaccttccgggtcggggtccacccctncatggccttcgtatcaaaagaatcttttctgggctgggggttaaaagctcccaactgaaataggggggccctttgaaaacccccggggccccgtgtgcaggggggaaaatgtgccaaggacccctttttgtgttcaatggaaggaaacaaaggtcgacactccccggaaaaactcttccaacccccaattaaaatttcccgggccccaaaaaatttttttgacaaaaaggggggtgtccccaatttaccccccccccccccccataaaaagagggggtatttccggg

SEQ ID NO: 38742 - DNA, 650 bp, Zea mays
  misc_feature: Ceres CLONE 1427792-F
  misc_feature: Encodes the peptide sequence at SEQ ID NO. 38743
  misc_feature (650)..(650): n is a, c, t, g, unknown, or other
aagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacccgtcggtgctgtggacggagagcaaggacgtgggcaagggcttccgctgcatccgcatgggcaacaacaccccgcctcaacttcaacgccttccacggcgaccaggaccaccggcggcgtgcacgaccgcacccccgtcctgctcctgggattggtgcaagggccagan

SEQ ID NO: 38743 - protein, 163 aa, Zea mays
  misc_feature: Ceres CLONE 1427792-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDPSVLWTESKDVGKGFRCIRMGNNTPPQLQRLPRRPGPPAACTTAPPSCSWDWCKGQ

SEQ ID NO: 38744 - DNA, 822 bp, Zea mays
  misc_feature: Ceres CLONE 1427794-F
  misc_feature: Encodes the peptide sequence at SEQ ID NO. 38745
  misc_feature (822)..(822): n is a, c, t, g, unknown, or other
ccttctcttttcgcccccccccgcccccggggtggtgacgtcttcctcaaaccagaactgggaactccccgcggtggcggccacaactaactagtgcaccccctgggctaattggatctcagcaccaatacctagaacatcctaatcgaaaaaaattctcagctattgagattttagcatttcatcctaaaaatgttctttcagattattcagggggttttcaccggcgttgaggcattagctctattggcattcgctggtataacccttggcggctcagcagtgggactagctttaagcacgccgctttttatcctattcagtccgattctcgtgccagcaactatagccaccactttgttaactacgggtttcacgacctccgggggcttaggaatggtggctctccgcatcttctggaaactcttcaagcgtcttaggaagaaggggaaaggaacgccaaaaattccgggattggccccgggggctccagattctgatccagtgtcctggaggataaacggagtagggctttcgtagtatgagataatctatggaggaatttaatgagtcttgctgggggtttccttaataaaaccctaaaaatatccagtgtcctttaaacgtaatactgattacgcgcggaagaaaaccaatggttcctatacccatttttcaaatggatatcgggggtacgaaattaattaataaatggacccccaatcacggttgtatatttttcaacacaattaaatgggaaatccctcggagatttccccctagaagggactttatattttcaaggttaaaaaaaacataaan

SEQ ID NO: 38745 - protein, 115 aa, Zea mays
  misc_feature: Ceres CLONE 1427794-F
  misc_feature (1)..(109): Pfam Name: Oleosin Pfam Description: Oleosin
MFFQIIQGVFTGVEALALLAFAGITLGGSAVGLALSTPLFILFSPILVPATIATTLLTTGFTTSGGLGMVALRIFWKLFKRLRKKGKGTPKIPGLAPGAPDSDPVSWRINGVGLS

SEQ ID NO: 38746 - DNA, 643 bp, Zea mays
  misc_feature: Ceres CLONE 1427796-F
  misc_feature: Encodes the peptide sequence at SEQ ID NO. 38747
aagctggagctccccgcggtggcggccgctctataactagtggatcccccgggctgcaggaattcgcacgagaccattacctagaacatcctaatcgaaaaatcgccccgcgaaccctagctcccgcaactgccgccgccactcccacgctcgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatcggaagaggacatcgccaaggagacggccaaggactgggaggggcctccgcgtcaccgtcagctcaccgtcagaaccgcaggccaagtctccgtcgtcccctccgcgcggcgctcgtcatcaaggcgctcaggagccgagagggaccgcagaaagtcaagacttcaagcacagggaaaattagcctcaacgactcattgaaatccccggaaccttaggcccggttcctgggcaagaaattggcgggccccccaggaaaacccgggacccgggtaaaggtggggggcccctcaaagggaaggacccccagggccctcccccgaaaatttcccaccggcggggggaaccccccccccctaaa

SEQ ID NO: 38747 - protein, 113 aa, Zea mays
  misc_feature: Ceres CLONE 1427796-F
MPPKLDPSQVVEVFVRVTGGEVGAASSLAPKIGPLGLSPKKIGRGHRQGDGQGLGGASASPSAHRQNRRPSLRRPLRAALVIKALRSREGPQKVKTSSTGKISLNDSLKSPEP

SEQ ID NO: 38748 - DNA, 770 bp, Zea mays
  misc_feature: Ceres CLONE 1427799-F
  misc_feature: Encodes the peptide sequence at SEQ ID NO. 38749
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
nnnnnnnnnnnnnnnnnnntttaaatnnnnngnnnnntganntggagagnnttcaagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgggtgtatttggtgaagatgttggccattacgggggttcttaacaagtggacaaaggggttggctggatccgttttggagaccttcgaggttctggacaccccgtatggcggagaaactcgtttactgggcatggggaggttggaagcggggaatgaaaaggggcctgagggccccctccgtttgaaaggcaatgagacattgggggaatcccctgcgtccccttggcctttacaagacccgaggagcgtcaaattgaacctgtggggggaatggctttccattttaacacctttcccggggcggagggcaaggtttaaaaaaatctccct

SEQ ID NO: 38749 - protein, 96 aa, Zea mays
  misc_feature: Ceres CLONE 1427799-F
MATAFSLRAAAPATAPRAVSRSTSAARVVPVASALAGRGRLVARAAVTAKADVPSSTSDGHEVLLFEALREALMEEMELDPTVGVFGEDVGHYGGS

SEQ ID NO: 38750 - DNA, 712 bp, Zea mays
  misc_feature: Ceres CLONE 1427803-F
  misc_feature: Encodes the peptide sequence at SEQ ID NO. 38751
tggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttaggggtggtatgcagatctttgtgaaaacccttactggcaagaccatcactcttgaggtgga

SEQ ID NO: 38751 - protein, 169 aa, Zea mays
  misc_feature: Ceres CLONE 1427803-F
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEV

SEQ ID NO: 38752 - DNA, 716 bp, Zea mays
  misc_feature: Ceres CLONE 1427814-F
  misc_feature: Translation starting site: 471
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccaccttcggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatcccagcccgtgccagctgcagggaacctgcggccgttgcagcaccccgatcctgggccagtgcgtcaagttcctgaggaatcagtgcagcccgaaggggaacgccttactgttcgcctcaatgccaatcctttgccgcaacaatgtttgcccacacctccgggcggggggagccccacccccgggaaccaggggaactttgggttgggcccccccgcccccccg

SEQ ID NO: 38753 - DNA, 687 bp, Zea mays
  misc_feature: Ceres CLONE 1427820-F
  misc_feature: Encodes the peptide sequence at SEQ ID NO. 38754
  misc_feature (548)..(548): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaaaggattttgtttcgggtgaggtggggggcggcatggcgccacccgccgctcaggctcagctcctcctctccaaccacccctcgccgttgctgtcgccgccgcaacgtcgtcgcctcctcggtggaccgccgcctcgctcacacacctgcgccatccggcaccaccacggccacgacaagtgcgcctcctcctcctccactcgccttcgccacgccctccgcccgcccgccgccaccgccgtggccatcgcgcccggcgaccactggggaaactgggccttcctcctctccgccgccgcgttcggcacatgggcggaggagaacacgtcgtggggcgccgcgctcagcggcgcgctggttagcatcatggccggcctggctgccacggccgtcggcctcgtcacccccggggcgcccgcgcacgacgccgtcatgaagtacctgctngcggccgccgtcccgctgctactccctcgcgccgacctccgccgcgtcgtccgcaccaccgggcgactnctccaggcattcctgctcggatctgttgcaactgtaatcggcacgacggtgggctatctgctgatcccca

SEQ ID NO: 38754 - protein, 184 aa, Zea mays
  misc_feature: Ceres CLONE 1427820-F
MAPPAAQAQLLLSNHPSPLLSPPQRRRLLGGPPPRSHTCAIRHHHGHDKCASSSSTRLRHALRPPAATAVAIAPGDHWGNWAFLLSAAAFGTWAEENTSWGAALSGALVSIMAGLAATAVGLVTPGAPAHDAVMKYLLAAAVPLLLPRADLRRVVRTTGRLLQAFLLGSVATVIGTTVGYLLIP

SEQ ID NO: 38755 - DNA, 818 bp, Zea mays
  misc_feature: Ceres CLONE 1427821-F
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
  misc_feature (53)..(53): n is a, c, t, g, unknown, or other
  misc_feature (632)..(632): n is a, c, t, g, unknown, or other
  misc_feature (750)..(750): n is a, c, t, g, unknown, or other
gtgccccccccccctggcgccttcaatctccccnnnnnnnnnnnnaaaanttnccaatactggagctccaccgcggtggcggccgctctataactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatgggtgaagggtagtgtgggtgcatcatggtgggcgttcctcctgctcgccggcgtgctgctggtcgtagcacccacggcccggggcggaaaggacgggagtgggtccaacgggacccgcaaggaggacctggcggtgggtgccaaccagggcctgccaaaggggcattcccggaaaggggcccccccccgcggaaaaaagggaaatggcaaagaaccaaaggggcccccaaagggggggcccccactaaaaatttaaccccggggggaaaagaaaacgggcaaccccggggggttgggaaaaccactttagtttttcccccgcccccggggagagggcgcaaaaggcccccccccccccnttctccccccccccccccaccaggggggcccaatccggggggagaaaacccacgggagggggttcggaggggcgggggccccccccccccccgcgggagaggggcgcgccataaaaanttaaaaaaaaagagaaggaggggggggggcgggcccaagaaagcggcgcggggagaatattccgggcg

SEQ ID NO: 38756 - DNA, 724 bp, Zea mays
  misc_feature: Ceres CLONE 1427824-F
  misc_feature: Encodes the peptide sequence at SEQ ID NO. 38757
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgcgccgctctcggtcatgaaattggtgatccagacaaagagcgtggaatacat

SEQ ID NO: 38757 - protein, 164 aa, Zea mays
  misc_feature: Ceres CLONE 1427824-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFGTGMYAAPLSVMKLVIQTKSVEY

SEQ ID NO: 38758 - DNA, 727 bp, Zea mays
  misc_feature: Ceres CLONE 1427825-F
  misc_feature: Encodes the peptide sequence at SEQ ID NO. 38759
  misc_feature (598)..(598): n is a, c, t, g, unknown, or other
  misc_feature (599)..(599): n is a, c, t, g, unknown, or other
  misc_feature (607)..(607): n is a, c, t, g, unknown, or other
  misc_feature (618)..(618): n is a, c, t, g, unknown, or other
  misc_feature (702)..(702): n is a, c, t, g, unknown, or other
  misc_feature (727)..(727): n is a, c, t, g, unknown, or other
aagctggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaatgaaaggagctgtnncagaagcngaagagatacnagcaaagacacccaactcttacatccttcaacaatttgaaaatccagctaacccaaagattcactatgagactactgggcctgnaatctggaaagctacagcaggaaan

SEQ ID NO: 38759 - protein, 174 aa, Zea mays
  misc_feature: Ceres CLONE 1427825-F
  misc_feature (12)..(175): Pfam Name: PALP Pfam Description: Pyridoxal-phosphate dependent enzyme
  misc_feature: SWISSPROT Homolog: EC 2.5.1.47 Cysteine synthase
  misc_feature (133)..(133): Xaa is any aa, unknown, or other
  misc_feature (139)..(139): Xaa is any aa, unknown, or other
  misc_feature (167)..(167): Xaa is any aa, unknown, or other
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVXEAEEIXAKTPNSYILQQFENPANPKIHYETTGPXIWKATAG

SEQ ID NO: 38760 - DNA, 722 bp, Zea mays
  misc_feature: Ceres CLONE 1427830-F
  misc_feature: Encodes the peptide sequence at SEQ ID NO. 38761
aaagctggagctccccgcggtggcggccgctctagaactagtggatcccccgggctgcaggaattcgcacgagaccattacctagaacatcctaatcgaaaaatcataaaaaaaagacaccctgcgtcatttaccgaccaccgtccatccatggatgcagccgagggccgaggggcagagtgggccgaggggcgtggcaggcggtgagcacgccggtggtcgggacggtacggatctcgtgatccatggccttcgcgggatggcgctgctccctgcttatgacacctcccgttcaccggcagcgaatcggggcttggcatttcccatcaagcattaagcagtgaagcaccccccctcgtttccaccggcagtccggcagcgagcagacagtaacagaatcaggcggtgtcttggaaataacttcagtgccatggcctggtctcatggaacatctccattatttccagtttacaagcttgagcagatcctgatgcgaggaccctccatctgtgatactctcgcacgctgctctcttcaaagaaagtgccctcgctctgatcgtatcatcagcgagcagctggttgactttgtccctgatctcctccttggtgaagacgccccgctcgttggcacggatcctcaagcccgtgccccacacgtcgcagatgtacttctggttcaagaactggtcggcaaagtatggcccacacaggaacgggacg

SEQ ID NO: 38761 - protein, 97 aa, Zea mays
  misc_feature: Ceres CLONE 1427830-F
MAWSHGTSPLFPVYKLEQILMRGPSICDTLARCSLQRKCPRSDRIISEQLVDFVPDLLLGEDAPLVGTDPQARAPHVADVLLVQELVGKVWPTQERD

SEQ ID NO: 38762 - DNA, 643 bp, Zea mays
  misc_feature: Ceres CLONE 1427832-F
  misc_feature: Encodes the peptide sequence at SEQ ID NO. 38763
ctccccgcggtggcggccgctctagaactagtggatcccccgggctgcaggaattcgcacgagaccattacctagaacatcctaatcgaaaagcgctctgtgcacagacgaccttcttcccatcccttcccttccctctgctagtctgcttcgttcctcggccatggtgggtcctcgccaagggtgagctcgagcagatcgccctcccggctgcagagccgcccccggccgacgtgcggtcggtggacctgtccgccccggcgggccccgcgcgcgaggccgcggcgcgcgcgctggtggcggcgtgcgaggagcacgggttcttccgggtgacgggccacggcgtgccggccagactcgtgcgcgccgcggaggccgcggcggccgggttcttcgcgcggccacagggcgagaaggaggaggaggcccccacgctcgggtacggaagcaagcgcatcgggcggcacggcgacctcggctgggtcgagtacctcctgctcggtgggaacaacccggcgccgccggggtcctcctcgggaataattgccctgggcccgcccccccccttccccgttcccgcccgggcggggcccctttccggaacctttttgggaaaaaaaaccgggggggggggggggggggg

SEQ ID NO: 38763 - protein, 213 aa, Zea mays
  misc_feature: Ceres CLONE 1427832-F
  misc_feature: SWISSPROT Homolog: EC 1.14.11.13 Gibberellin 2-beta-dioxygenase
PRGGGRSRTSGSPGLQEFARDHYLEHPNRKALCAQTTFFPSLPFPLLVCFVPRPWWVLAKGELEQIALPAAEPPPADVRSVDLSAPAGPAREAAARALVAACEEHGFFRVTGHGVPARLVRAAEAAAAGFFARPQGEKEEEAPTLGYGSKRIGRHGDLGWVEYLLLGGNNPAPPGSSSGIIALGPPPPFPVPARAGPLSGTFLGKKTGGGGGG

SEQ ID NO: 38764 - DNA, 714 bp, Zea mays
  misc_feature: Ceres CLONE 1427834-F
  misc_feature: Encodes the peptide sequence at SEQ ID NO. 38765
aaagctggagctccccgcggtggcggccgctctagaactagtggatcccccgggctgcaggaattcgcacgagaccattacctagaacatcctaatcgaaaaaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgagttcgaccggctgagcgcgctcggcccggtggccaccctcgccggctcgcagtacacgctgaacctcacctacgacatgggcaccgtccgcgtgaagtccatgtggt

SEQ ID NO: 38765 - protein, 171 aa, Zea mays
  misc_feature: Ceres CLONE 1427834-F
  misc_feature (64)..(170): Pfam Name: Fasciclin Pfam Description: Fasciclin domain
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFANLTQDQLRSLLLCHALPKYYSLAEFDRLSALGPVATLAGSQYTLNLTYDMGTVRVKSMW

SEQ ID NO: 38766 - DNA, 765 bp, Zea mays
  misc_feature: Ceres CLONE 1427837-F
  misc_feature: Encodes the peptide sequence at SEQ ID NO. 38767
  misc_feature (522)..(522): n is a, c, t, g, unknown, or other
aagctggagctccccgcggtggcggccgctctagaactagtggatcccccgggctgcaggaattcgcacgagaccattacctagaacatcctaatcgaaaatcccacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggcgagcaggcgggaatctccgccgtcatcccaggatggttctccgagatcagccccatgtggcccggtgaggcgcactccttgaaggtggagaagggtctgttccagggcgaggcggactatcaaagtgtggatggtcttcacggccctccacggacgggtaagggggcttgtcctcctacggaggtatgtctgggggacagggcaggcganggagcgcccgttgccgggaaggtgagttagtatgctgctcgcttgtgctcactcagaggagcgcagtggaggggtctgggttatggaggggggggtggtggggaatgcggggggcaggggcagggggggggctgggagatggggggtggagtgggggggaggacggtgtggggggtgtggggcctgcgggacgccgggggaggagttcattgcgaacggtggcagaggggacggggggggtgg

SEQ ID NO: 38767 - protein, 111 aa, Zea mays
  misc_feature: Ceres CLONE 1427837-F
  misc_feature: SWISSPROT Homolog: EC 2.5.1.16 Spermidine synthase
  misc_feature (102)..(102): Xaa is any aa, unknown, or other
MEAEAAAKRAREGGEDATAPVAGAEAVVAGAGEQAGISAVIPGWFSEISPMWPGEAHSLKVEKGLFQGEADYQSVDGLHGPPRTGKGACPPTEVCLGDRAGXGAPVAGKVS

SEQ ID NO: 38768 - DNA, 700 bp, Zea mays
  misc_feature: Ceres CLONE 1427838-F
  misc_feature: Encodes the peptide sequence at SEQ ID NO. 38769
  misc_feature (360)..(360): n is a, c, t, g, unknown, or other
  misc_feature (670)..(670): n is a, c, t, g, unknown, or other
ctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggagcaacaggggcttgccagcttgatggcgtgtccctccctgatgctgcagcaactgttggccttaccgcttcnaccaatgcccgtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacnataaaacaagtttcctcttattaccagaag

SEQ ID NO: 38769 - protein, 64 aa, Zea mays
  misc_feature: Ceres CLONE 1427838-F
MGKGSVGASWWAFLLLAGVLLVVAATAGATGACQLDGVSLPDAAATVGLTASTNARDDATDDDA

SEQ ID NO: 38770 - DNA, 698 bp, Zea mays
  misc_feature: Ceres CLONE 1427840-F
  misc_feature: Encodes the peptide sequence at SEQ ID NO. 38771
  misc_feature (297)..(297): n is a, c, t, g, unknown, or other
  misc_feature (298)..(298): n is a, c, t, g, unknown, or other
  misc_feature (425)..(425): n is a, c, t, g, unknown, or other
aaagctggagctccccgcggtggcggccgctctagaactagtggatcccccgggctgcaggaattcgcacgagaccattacctagaacatcctaatcgaaaaagcgtgtctcgtgctccccccaggctcctcttcctcgctttccctccaccccgggcgcaaaccctaactttaccgtcgctcgccccgcggcgtctgccaatggcgcgccccgtgtgagtgtgcgcgagagaggggtagaccttgaggccgctacccggggaggagagcgagagatgtataaacagggggggagcnnggggtgagggtgctagggctggaccggaggcagatcaacgacgcgctggataagcatgctcgagaagggcgcgcgtcgccatcgacagtcgaggggtcgggggtgcggcgggcagcgaccaccaccngcctcgtcgtgccgtcctccgtgtcgtccatccccaaaggccgctgctcccgaaggggagtctgattctgatagtgaagcatcggatgtttagcgctctgatggagaagaaccctcatggatttcatggtattgcaaccttagagggaatgagtccttcttgtaaagcgacgatgattatattcagaacgacctccacttttggggcctcagcaagcaaagttccttaatatgaattaggccccccgactcctttttaaatcccaggcctccc

SEQ ID NO: 38771 - protein, 54 aa, Zea mays
  misc_feature: Ceres CLONE 1427840-F
MLEKGARRHRQSRGRGCGGQRPPPASSCRPPCRPSPKAAAPEGESDSDSEASDV

SEQ ID NO: 38772 - DNA, 617 bp, Zea mays
  misc_feature: Ceres CLONE 1427842-F
  misc_feature: SWISSPROT Homolog: EC 1.1.1.100 3-oxoacyl-[acyl-carrier-protein] reductase
  misc_feature (29)..(29): n is a, c, t, g, unknown, or other
  misc_feature (349)..(349): n is a, c, t, g, unknown, or other
  misc_feature (397)..(397): n is a, c, t, g, unknown, or other
  misc_feature (423)..(423): n is a, c, t, g, unknown, or other
  misc_feature (450)..(450): n is a, c, t, g, unknown, or other
tccccgcggtggcggccgctctagaactnagtggatcccccgggctgcaggaattcgcacgagaccattacctagaacatcctaatcaaaaactccccgactcctccccatcgcccatcgccgccctccgatccttcatggccgctgccacagccgccgccgccgcgctcgcctccccggcgggcctctccacatcgctggccgccgcggcctcgtcagcttcgcacccgcgctccggcccggccctgaccgcagctctcgcgccgtcgccctcctcggtgtacgaactcatgtcacggctgttgatcaagccattgtaaaaggtgatacaaagttggaaggtcctgtnggtgttgttactggtgcttccagggggaatggaaaagccactgcattngcctcttggaaaaacagctgcaaggnctggggaatatgctcgatctcaaagangctgaagagcctccaagaaaatgagcatctggaggccagccaatcctttggaaggaaagtttccaaaaaaggctaagtttaaaccttgaaaaaaagggcttgttaaacctgggggaacccttgtattccccctaaaaaaaaagccggaatccccccgggacacattt

SEQ ID NO: 38773 - DNA, 708 bp, Zea mays
  misc_feature: Ceres CLONE 1427845-F
  misc_feature: Encodes the peptide sequence at SEQ ID NO. 38774
  misc_feature (677)..(677): n is a, c, t, g, unknown, or other
ccccgcggtggcggccgctctagatctcgtggatcccccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacaaagaagcagctgatgatccaagtagcagagctagttcccaagcatcacggaaggacaaagaagcaagagttcaatttgaggaaacctccatccttccactatgatttgcttctcttaggcttcctgacgttaatgtgtggccttattggtatccctccatcaaatggtgtcattcccacatcacccatgcacacgaagagtttggctactctncagcatcagctgcttcgtaaccggctagtag

SEQ ID NO: 38774 - protein, 185 aa, Zea mays
  misc_feature: Ceres CLONE 1427845-F
  misc_feature (24)..(120): Pfam Name: SRP19 Pfam Description: SRP19 protein
MATSNTARMEDGGGDLRSTIKKWNIIYPVYLNSKKTVAEGRRIAAAKACPDPTCIEIADCCSHLKIPHAIELDKAYPRDFFQVGRVRVQLKKDDGSPVNPAIKTKKQLMIQVAELVPKHHGRTKKQEFNLRKPPSFHYDLLLLGFLTLMCGLIGIPPSNGVIPTSPMHTKSLATLQHQLLRNRLV

SEQ ID NO: 38775 - DNA, 630 bp, Zea mays
  misc_feature: Ceres CLONE 1427848-F
  misc_feature: Encodes the peptide sequence at SEQ ID NO. 38776
  misc_feature (108)..(108): n is a, c, t, g, unknown, or other
ccccgcggtggcggccgctctagaactagtggatcccccgggctgcaggaattcgcacgagaccattacctagaacatcctaatcgaaaaaaggaaagaacataggcnagccgaagcgactggtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacgggggggcacaagccggagtacacggtgggacgtgtggtccggaaaaccacccctactatgtcggcgacccctcggcgctcgtggtcatggaacacccgaatcaaaaaagttcggcaagaagtggggccaccatcagggaatacctgccccgaggacccatgggaagggaaatgccccccaaaccgggaaccccggaattttagcccccaaggggaaaaacctgattggatgggttcccccgttttttcttcacccgggggggggggcccccgggcccccgttttacattttccccccct

SEQ ID NO: 38776 - protein, 129 aa, Zea mays
  misc_feature: Ceres CLONE 1427848-F
MRCSMRKKGLHPEIYEDAKVYCNGELVLVTGGHKPEYTVGRVVRKTTPTMSATPRRSWSWNTRIKKVRQEVGPPSGNTCPEDPWEGKCPPNREPRNFSPQGEKPDWMGSPVFSSPGGGGPRAPVLHFPP

SEQ ID NO: 38777 - DNA, 640 bp, Zea mays
  misc_feature: Ceres CLONE 1427849-F
  misc_feature: Encodes the peptide sequence at SEQ ID NO. 38778
  misc_feature (151)..(151): n is a, c, t, g, unknown, or other
  misc_feature (163)..(163): n is a, c, t, g, unknown, or other
  misc_feature (318)..(318): n is a, c, t, g, unknown, or other
  misc_feature (330)..(330): n is a, c, t, g, unknown, or other
  misc_feature (339)..(339): n is a, c, t, g, unknown, or other
ctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggnccggcggcaccngcgctcgcagggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgancaggggccgacngcgtcgcangcgctgacggtggcgacgctgttcccgctgggccgggctgctgcctggtgctgttcggggctgggcccttaacggccctccctgggggggggcttggccctgggcccaccccccgggtttcttaaatttttaacccccgggtggggccccccccccgcttttttatttgggaagaggcccttatgggggtttccccccgccgggggcccctttggggtcctggggggcttttcccccctccaaagggccccccccaaaaaaggggggggaggggggttttcccccccccccccgagaatat

SEQ ID NO: 38778 - protein, 70 aa, Zea mays
  misc_feature: Ceres CLONE 1427849-F
  misc_feature (40)..(40): Xaa is any aa, unknown, or other
  misc_feature (47)..(47): Xaa is any aa, unknown, or other
MADRDRSGIYGGAHATYGQQQQQGGGGRPMGEQVKGMLHXQGPTASXALTVATLFPLGRAAAWCCSGLGP

SEQ ID NO: 38779 - DNA, 731 bp, Zea mays
  misc_feature: Ceres CLONE 1427860-F
  misc_feature: Encodes the peptide sequence at SEQ ID NO. 38780
  misc_feature (647)..(647): n is a, c, t, g, unknown, or other
  misc_feature (655)..(655): n is a, c, t, g, unknown, or other
  misc_feature (658)..(658): n is a, c, t, g, unknown, or other
  misc_feature (660)..(660): n is a, c, t, g, unknown, or other
aaaactggagctccccgcggtggcggccgctctagaactagtggatcccccgggctgcaggaattcgcacgagaccattacctagaacatcctaatcgaaaaaccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaggcggtgggcggcgggcagtgcccggccctggggtgcgcggcggacctcaacgccgggtgcccgccctcgcagcgcgtgccgggggccggggggcngccttggntgncntgcaaaggcccccgcggctacttcaaggagcggtgcccgctgacgcgcaccacgcccaccgacgtggagcc

SEQ ID NO: 38780 - protein, 195 aa, Zea mays
  misc_feature: Ceres CLONE 1427860-F
  misc_feature (34)..(195): Pfam Name: Thaumatin Pfam Description: Thaumatin family
  misc_feature (168)..(168): Xaa is any aa, unknown, or other
  misc_feature (171)..(171): Xaa is any aa, unknown, or other
  misc_feature (172)..(172): Xaa is any aa, unknown, or other
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPQAVGGGQCPALGCAADLNAGCPPSQRVPGAGGXPWXXCKGPRGYFKERCPLTRTTPTDVE

SEQ ID NO: 38781 - DNA, 771 bp, Zea mays
  misc_feature: Ceres CLONE 1427863-F
  misc_feature: Encodes the peptide sequence at SEQ ID NO. 38782
aaaactggagctccccgcggtggcggccgctctatactagtggatcccccgggctgcaggaattcgcacgagaccattacctagaacatcctaatcgaaaaactccgatcctgccctctaataacagcagcagcagccgccatggaaggcagcagcaagaagctccagccgttcctcctcacgctgctgctggtgctctccaccgccgtgacgcccatcctctcgctgtcagtgccagacgacgaggtagcctgcgactgcgacaaacccaaggcgcccaagccgtcgcacccgcccaagaccaagccctcccacccgtcgccgaagcccaagaaccccaagccacccaagggcggcaccgggtacccggcgccagggcaccaaccgcccaagagcccctcctaccccccggtcgtcggccctcccaagggccccgtcacgcgcccgccagtcacgcgtccgccggtcgtcggtcctcccaagggccccgatcacgcgaccggacggtcacgctgtccggcgggttgtgtgaacaacgggcgacccaacccgccgaaaaacggggcctttcgaaaagacgcccccccgggtgtccggatcccctgggtggacattacctctctaaatacagggggctctcaaaaagaacctcctttgtttgtttgggacccagggagggggggaaggggaggagaacccccggggtcgagggggagaaggaggaaggccccggtggtagcaccgaagcccgctctgagaaactaccatact

SEQ ID NO: 38782 - protein, 210 aa, Zea mays
  misc_feature: Ceres CLONE 1427863-F
MEGSSKKLQPFLLTLLLVLSTAVTPILSLSVPDDEVACDCDKPKAPKPSHPPKTKPSHPSPKPKNPKPPKGGTGYPAPGHQPPKSPSYPPVVGPPKGPVTRPPVTRPPVVGPPKGPDHATGRSRCPAGCVNNGRPNPPKNGAFRKDAPPGVRIPWVDITSLNTGGSQKEPPLFVWDPGRGGRGGEPPGSRGRRRKAPVVAPKPALRNYHT

SEQ ID NO: 38783 - DNA, 678 bp, Zea mays
  misc_feature: Ceres CLONE 1427864-F
  misc_feature: Encodes the peptide sequence at SEQ ID NO. 38784
gctctagaactagtggatcccccgggctgcaggaattcgcacgagaccattgcctagaacatcctaatcgaaaaattttccgtacgccgtacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgccactcgccggggtccgggtcgagtcgctcgacctgttccagtgccccgtcaccaaggtcaaggggtacagggatgaggtcttcgcgctgattcccagcctcaagtacctcgatggcgctgacgctgagggcaacgagcgtttggagacggatgacgaccac

SEQ ID NO: 38784 - protein, 176 aa, Zea mays
  misc_feature: Ceres CLONE 1427864-F
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLGNNRFAEVQELAPLAGVRVESLDLFQCPVTKVKGYRDEVFALIPSLKYLDGADAEGNERLETDDDH

SEQ ID NO: 38785 - DNA, 690 bp, Zea mays
  misc_feature: Ceres CLONE 1427870-F
  misc_feature: Encodes the peptide sequence at SEQ ID NO. 38786
gcggtggcggccgctctagaactagtggatcccccgggctgcaggaattcgcacgagaccattacctagaacatcctaatcgaaaaaatgtcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggtaaaacctcccccgcgctccggccatgcgccggcgccgcagccgcttgccatcgagcagccatggctcacgatcgacgctctgtgtgtctgcgtgcgtggtttgcaggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcgtcgacttcgacttcgtcaccgtcgacaactgccagaagagcaagatcttcttcatcgcctggtcaccggcggcgtcgaggatcagggccaagatcctgtacgcgacatcgaagcaaggcctgcggcggctgctggacggg

SEQ ID NO: 38786 - protein, 156 aa, Zea mays
  misc_feature: Ceres CLONE 1427870-F
  misc_feature (52)..(156): Pfam Name: Cofilin_ADF Pfam Description: Cofilin/tropomyosin-type actin-binding protein
MAMAYKMVKPPPRSGHAPAPQPLAIEQPWLTIDALCVCVRGLQATEGMNVKEECQRWFMEMKWKKVHRFVVYKIDERSRAVLVDKVGGPGEGYEELVAALPGDDCRYAVVDFDFVTVDNCQKSKIFFIAWSPAASRIRAKILYATSKQGLRRLLDG

SEQ ID NO: 38787 - DNA, 736 bp, Zea mays
  misc_feature: Ceres CLONE 1427877-F
  misc_feature: Translation starting site: 511
caaactggagctccccgcggtggcggccgctcttgatctagtggattccccgggctggcgggaattcccacgagaccctttccctgaacatcctaatccaaaaaaaaagatcattgacgccttctccgttcccgactactcccgtgagcgtctagcggcgactgggcgaggccctgggcgccggggtcggctcccgccctagcatcgccgatgccgcggggggtatgctgacccgtaagccgagagggagaggctcgtgagccgggcgcctcctcaacccgaaggaggaggactacatccagaacgtccgtgcaggtgtctctcccacccgagggtcaggggctcccgcggcgactgccggcgatgcttcctccacaagaacgggcttagcggcgacgagatcgatcaggcgttccgaagggttcctgatcctcatcccagcactactgctaccacttctccgcagcagcatgtcaacggccacaatcaatcccgccggggtgcaagcttatgcgccatcacaacctgtggcccctgcagacgctggcgcctgtcgtccttccaacgcagcccaggtttaactggtaccgagcattcctggcggcacggcacttgcttggttttggtgctagcgctgctgtctttttcatggaactgttccttcctaggctcacgtcttggatccgcagtgttgtactacaacggtagtggccctgaagggaactgcgttgcgctg

SEQ ID NO: 38788 - DNA, 679 bp, Zea mays
  misc_feature: Ceres CLONE 1427881-F
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatactgtaccaacaatggcagccaaaatattttgcctccatatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaactggcaatcacagctggcatcttacctttatcacccttgttcctcccacaatcatcagccctattacatcagttacctttggtgcatttattggcacaaaacatcagggcacaacaactacaacaacttgtgctagcacaccttgctgcctactctcagcaacagcagtttcttctattcaaccaactacctgcattgaacctctggctcttatttgcaacaacagccaactacctttcagccagatacttggtgctaaccccaaaaattcttcccttcaaccaatggcagctttaaacctcctgctttattaccgcaccaacacctactaccttttgggcag

SEQ ID NO: 38789 - DNA, 801 bp, Zea mays
  misc_feature: Ceres CLONE 1427888-F
  misc_feature: Encodes the peptide sequence at SEQ ID NO. 38790
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (28)..(28): n is a, c, t, g, unknown, or other
  misc_feature (33)..(33): n is a, c, t, g, unknown, or other
  misc_feature (45)..(45): n is a, c, t, g, unknown, or other
  misc_feature (47)..(47): n is a, c, t, g, unknown, or other
  misc_feature (741)..(741): n is a, c, t, g, unknown, or other
gtgccccccccccccnnnncctataaantgatntttctcctctangnttgtttttttcaaactgggactccccgcggtggcggccgctctagaatagtggatcccccgggctgcaggaattcgcacgagaccattacctagaacatcataatcgaaaagagccgtggctgacgccatggagaccgcccttgtgctgcctgagaacgagaagaggctgcgccacgataagcacttccgctacgtgagcacccccaacgtcgggtaatggggctaaaacttcctccttgaccctgggaagacctggaagtttctttctcaaaaaagtgctgggggattggcttcgccctgcggtcaaaaagtggtcccccccccccggccccttgggaaagttttcctttgggaaacaccctttttgggattccccggaaaaccaaaaaaccggggaatttttggcgggggaaaaaaaggggccccccttttttccccccccccccaaaaaaaaaaaacccccccccacaaaaaaatttttttggggggaaatttcacaaaaacccctgttttctaaaaaaaaaaaaaaaaaaaggggttggcccccccctcccccccgggggtgtaaataggggcggcaccccctccctcaaaaaaggagaaccccccctcctaaaaaaacacattctttttatcccccccggcgcgagagaacgccctttccctctccgcggggggaaagagggaggcggncaaaagggaaaaaaaaataatttgtgggttctccccacacccctgtacttgtgtgaataa

SEQ ID NO: 38790 - protein, 29 aa, Zea mays
  misc_feature: Ceres CLONE 1427888-F
METALVLPENEKRLRHDKHFRYVSTPNVG

SEQ ID NO: 38791 - DNA, 677 bp, Zea mays
  misc_feature: Ceres CLONE 1427891-F
  misc_feature (187)..(187): n is a, c, t, g, unknown, or other
  misc_feature (343)..(343): n is a, c, t, g, unknown, or other
  misc_feature (413)..(413): n is a, c, t, g, unknown, or other
  misc_feature (416)..(416): n is a, c, t, g, unknown, or other
  misc_feature (533)..(533): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcaaaaaaacccgatcgacaccatgagggtgttgctcnttgccctcgctctcctggctctcgctgcaaggcgccacctccacgcatacaaggcggcggctgcggctgccagccaccgccgccggttcatctacgcgcgccggtgcatctgcccacctccggttcacctgccacctccggtgcatctcccaccgncggtccacctgccgccgcccggtcaccctgcacccccccgtcatggtgcggcggcggggtcatcgtgccnccnccaccatgccactaccctactcaaccgccccgggctcagcctcatccccagccacaccccatgcccgtggcaacaggccgcatccaagcccctgccagctgcagggaacctgcggcntttgcaccacccccatcctggggcagtgcgtcaatttctaaagcatcagtggagcccgacgggaaccgcctactggctcccctatgccagtcgttgcggcacattttttccccacctcaggggggtgaccccacccccgtaccg

SEQ ID NO: 38792 - DNA, 636 bp, Zea mays
  misc_feature: Ceres CLONE 1427892-F
  misc_feature: Encodes the peptide sequence at SEQ ID NO. 38793
  misc_feature (408)..(408): n is a, c, t, g, unknown, or other
  misc_feature (477)..(477): n is a, c, t, g, unknown, or other
ctccccgcggtggcggccgctctagaactagtggatcccccgggctgcaggaattcgcacgagaccattacctagaacatcctaatcgaaaacacaccacacgccagccagccatcgtcacactggtgagctctgcactctgcttagctccgagcttcagtgccttcgttgtttggtccacgcagtccacacacacacaccagtacgtccagctgcactgcaccaatggccgccgtcgaggtccaggtcccgactgccgctcccgtcgaggaggttgcccagctggccgccgcctccgccgtcgagatcccgaacgaggagaccgctgctccggcggggagaccgaggtcgtcgtcgctaaggagccggtgccggccgaggccgagactgagtccaaggagtcgaggntcgagctgaagccgagccgaggccgtagctgaagctgagccgaccgagcagagcccgagccgccttgcngcagcagaaacgaagccaggaagcagagcgggagcccgctttgccgcaacaaaaacggaggctgctgctgcccccgtcaaggctgctgaacccgaaaatacccccccaaaacaaaaaaggtggcggctttggaaggcctaaccgggggggggggggggg

SEQ ID NO: 38793 - protein, 63 aa, Zea mays
  misc_feature: Ceres CLONE 1427892-F
MAAVEVQVPTAAPVEEVAQLAAASAVEIPNEETAAPAGRPRSSSLRSRCRPRPRLSPRSRGSS

SEQ ID NO: 38794 - DNA, 737 bp, Zea mays
  misc_feature: Ceres CLONE 1427894-F
  misc_feature: Encodes the peptide sequence at SEQ ID NO. 38795
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcaaaaagaatgggtgttggtatcggttgcagcgtggaaatagttaattgaggatctaaggaaactggtctggtagtgagtagtgactatagagtagaaaataactggtgtccttggtgctgcatgcaggagacgctcaacatgttcttggggatgggccggccggcgtggagggaggcgcgcgccacgctacagaaaatcctatcagccgacgagcccgtcttgcgtgacaacgaagcactgaggaacaagtgtctggtaccaatgagtgatatagagatggttctaccaatcacggttggaggttacacggacttcttttgttctgtgcaccatgcaatgaattgtggattcatcttccgagggccgcagactccagtcaatccaaattggttttatcttccagtaggatacaatgggcgagcatcatctatagttgtgtctggaaccaatgtcattaggcccaggggacaaggacatccaacaggaaactccgctccttattttggtccctcgcagaagcttgattttgagcttgagatggctgccattgttggtccagggaatgaattaggcaaacctattgatattaatgacgccgaaagacatanttttggcctaactttgatgaatgattggagt

SEQ ID NO: 38795 - protein, 173 aa, Zea mays
  misc_feature: Ceres CLONE 1427894-F
  misc_feature (1)..(56): Pfam Name: DUF1969 Pfam Description: Domain of unknown function (DUF1969)
  misc_feature (86)..(173): Pfam Name: FAA_hydrolase Pfam Description: Fumarylacetoacetate (FAA) hydrolase family
  misc_feature: SWISSPROT Homolog: EC 3.7.1.2 Fumarylacetoacetase
  misc_feature (163)..(163): Xaa is any aa, unknown, or other
MQETLNMFLGMGRPAWREARATLQKILSADEPVLRDNEALRNKCLVPMSDIEMVLPITVGGYTDFFCSVHHAMNCGFIFRGPQTPVNPNWFYLPVGYNGRASSIVVSGTNVIRPRGQGHPTGNSAPYFGPSQKLDFELEMAAIVGPGNELGKPIDINDAERHXFGLTLMNDWS

SEQ ID NO: 38796 - DNA, 655 bp, Zea mays
  misc_feature: Ceres CLONE 1427895-F
  misc_feature: Translation starting site: 213
  misc_feature (281)..(281): n is a, c, t, g, unknown, or other
  misc_feature (302)..(302): n is a, c, t, g, unknown, or other
  misc_feature (305)..(305): n is a, c, t, g, unknown, or other
  misc_feature (393)..(393): n is a, c, t, g, unknown, or other
  misc_feature (536)..(536): n is a, c, t, g, unknown, or other
  misc_feature (581)..(581): n is a, c, t, g, unknown, or other
  misc_feature (582)..(582): n is a, c, t, g, unknown, or other
  misc_feature (630)..(630): n is a, c, t, g, unknown, or other
  misc_feature (633)..(633): n is a, c, t, g, unknown, or other
tggagctccccgcggtggcggccgctctagaactagtggatcccccgggctgcgggaattcgcacgagaccattacctagaacatcctaatcgaaaaacaacaccagaatccgcgaatcacagacgcgtctatctcagcttgctgcactgcactaccctgccctgccatcatatcgtacgtgagcccggccgagcgagagcgagggagaggcatggctgctccaaagctcgcgacgctggcgctggccgtgctcctggcggcgacgcgtgtggctcccccngccgcggtgcgcgcggcaatntcntgctccaccgtgtacagcacgctgatgcccgtgcctgccgttcgtccagatgggcgggggccatgcggccccagcccgtgctgcggcnggcatccgcagccctgctgcagcaggccaacaacaccccccgaccgccgcaccatgctgcggctgcctcaagaacgtcgccaacgggcgcgacggggagcgcacctacatcaggcgcgccgcgcgctgcccagcaagtgcggntcccccctgcgtacagatcagcacaacgttactgcacacgataanntagtgatgagggctctgggcgctccgggcaagaatgcatgctgggctngcnaaataataaatatgctctgtat

SEQ ID NO: 38797 - DNA, 629 bp, Zea mays
  misc_feature: Ceres CLONE 1427896-F
  misc_feature: Encodes the peptide sequence at SEQ ID NO. 38798
  misc_feature (276)..(276): n is a, c, t, g, unknown, or other
  misc_feature (381)..(381): n is a, c, t, g, unknown, or other
  misc_feature (382)..(382): n is a, c, t, g, unknown, or other
  misc_feature (384)..(384): n is a, c, t, g, unknown, or other
gctctagaactagtggatcccccgggctgcaggaattcgcacgagaccattacctagaacatcctaatcgaaaagtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactaacagaacggcgtggggagaatcaggagaagagataggnagggggggctagttaagctgaactcctgccccaccaaaaaatgcccgaattgggtatggaaacagggggggggggccgcttcctggtgtcaacctcttattgtannanattttcccacgcttcccaaagtggaacccaaccacttcaatcacgggagaccactttaccccccgggtgcccgaaaacggcgcacgttctaactttcttggggtcgcctccctggcccacggcttggttggggccccgcctcccagttttgggcgggggtggcacccaacgggccgcctggggggccacaaaagcctgggccacccaaaagcccgcgtcgttccctcaatcgcccgggggccatt

SEQ ID NO: 38798 - protein, 62 aa, Zea mays
  misc_feature: Ceres CLONE 1427896-F
SRTSGSPGLQEFARDHYLEHPNRKVNASLSIRIGLNTVATSASATVPQLPARHYCKLCSIKA

SEQ ID NO: 38799 - DNA, 558 bp, Zea mays
  misc_feature: Ceres CLONE 1427897-F
  misc_feature: Encodes the peptide sequence at SEQ ID NO. 38800
agctccccgcggtggcggccgctctagaactagtggatcccccgggctgcaggaattcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcggcggcgtccaacaacctggtggtgtcgttcggcgagatgctgatcgaatttcctcccccgacgtggccggggtggtcccctggcccaaattcgggggggttttcctcaagggcccccgggggggggggcccggcaaaaggttggcccggggggccatattccccaaaaagttgggggggaaaccccccccccctttcttggggaaaaatttcggggaaaaaaaaaaaaaattttgggggaccaaaatgttggggggggaaaaaaacccccccggaaaaggaaaaaaaaaaacccgggggggagggagcggg

SEQ ID NO: 38800 - protein, 115 aa, Zea mays
  misc_feature: Ceres CLONE 1427897-F
  misc_feature: SWISSPROT Homolog: EC 2.7.1.4 Fructokinase
MAPLGDGGAAAAAASNNLVVSFGEMLIEFPPPTWPGWSPGPNSGGFSSRAPGGGGPAKGWPGGPYSPKSWGGNPPPLSWGKISGKKKKNFGGPKCWGGKKTPPEKEKKKPGGEGA

SEQ ID NO: 38801 - DNA, 742 bp, Zea mays
  misc_feature: Ceres CLONE 1427898-F
  misc_feature: Encodes the peptide sequence at SEQ ID NO. 38802
aaagctggagctccccgcggtggcggccgctctagaactagtggatcccccgggctgcaggaattcgcacgagaccattacctagaacatcctaatcgaaaagttcctccgcgacccagcgacgcctccgcggccgtccgatcgccctatccgccgccgcgcgattccggcaggggagtagacggttccagcaaatttggtccaacaattctttgtttggccgcttgggctccggtctctcgattcttcgtagcttggtgggagggcgccggatccagcggccatcatggttgtcgacacggtcagcgcgagcacctccataatagccccccacctgttcgaccacaggtccagggtagccggcgcttcccaccaccacctccgccggacgttccatgtcgttgcctgccgacccctgcccaccgccttcgccggccgccgcctcgtggcccgggtcaccaggcagccgtcgtcgcgcctcgccgattggccggtcagggcgctggctatgggggtcacgaacgaggtcaggtccagccctcgcagggagtatcgggggatccccggggatggtggcgacatgcgggacgttggggctccccaccccccccccgtccccccccccccctgcaccccccccttccccccctcctcccccccacccctcacaccacctcacaccaaatctccctccccctctcttcccctttccctccattctgttttcgctctcccatcccac

SEQ ID NO: 38802 - protein, 152 aa, Zea mays
  misc_feature: Ceres CLONE 1427898-F
MVVDTVSASTSIIAPHLFDHRSRVAGASHHHLRRTFHVVACRPLPTAFAGRRLVARVTRQPSSRLADWPVRALAMGVTNEVRSSPRREYRGIPGDGGDMRDVGAPHPPPVPPPPCTPPFPPSSPPPLTPPHTKSPSPSLPLSLHSVFALPSH

SEQ ID NO: 38803 - DNA, 671 bp, Zea mays
  misc_feature: Ceres CLONE 1427902-F
  misc_feature: Encodes the peptide sequence at SEQ ID NO. 38804
  misc_feature (202)..(202): n is a, c, t, g, unknown, or other
  misc_feature (364)..(364): n is a, c, t, g, unknown, or other
  misc_feature (421)..(421): n is a, c, t, g, unknown, or other
  misc_feature (445)..(445): n is a, c, t, g, unknown, or other
  misc_feature (447)..(447): n is a, c, t, g, unknown, or other
  misc_feature (459)..(459): n is a, c, t, g, unknown, or other
  misc_feature (473)..(473): n is a, c, t, g, unknown, or other
ctggagctccccgcggtggcggccgctctagaactagtggatcccccgggctgcaggaattcgcacgagaccattacctagaacatcctaatcgaaaacttagaggtgggttggcttctcctccccctccggttcgggttcgggttcgtgaggttctccggggttcgggttcgtgggtgagcggatcgagatggcggcgtcngatgttgagtaccgctgcttcgtcggcggcctcgcccctggcacggacgaccactccctccacaacgccttcagcacctacggcgaggtcctcgagtccaagatcatcctcgatcgggagacgcagaagtcccgcggcttcggcttcgtcaccttctccacngaggaagcaatgcggaacggcatcgagggcataaacggcaaggagctggacggcccncacatcaccgtcaacgaggcccantncccgcgcggccngtgaagcggcggcngtggttaccgtggtggccctggaggcggcggctacgggggtgggcgggcgcccttatgggcgtggcggctacggcgggtgcgcgccgctacgggtggcggcgggcgctaccggtggttgtgggcgcccgcttaccggcgttggcaaccgtggggggcggctaccgcaaactccaacggggaatggaggaaactgaggg

SEQ ID NO: 38804 - protein, 89 aa, Zea mays
  misc_feature: Ceres CLONE 1427902-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (85)..(85): Xaa is any aa, unknown, or other
  misc_feature (86)..(86): Xaa is any aa, unknown, or other
MAASDVEYRCFVGGLAPGTDDHSLHNAFSTYGEVLESKIILDRETQKSRGFGFVTFSTEEAMRNGIEGINGKELDGPHITVNEAXXPRG

SEQ ID NO: 38805 - DNA, 784 bp, Zea mays
  misc_feature: Ceres CLONE 1427903-F
  misc_feature: Encodes the peptide sequence at SEQ ID NO. 38806
  misc_feature (45)..(45): n is a, c, t, g, unknown, or other
  misc_feature (46)..(46): n is a, c, t, g, unknown, or other
  misc_feature (784)..(784): n is a, c, t, g, unknown, or other
tggcgccccccagccacacaaaaagagtgggggtgggtggggggnntttttaaaatggaactccacgcggtggcggccgctctagattcaaagaatcccccgggctgcaggaattttcccgagaccattacctagaacatcctaatcgaaaactcggctcatctcatttttctatttcggcccctctactgttccaataataataaaaagattctcgattcgatttacgcgccaattttcagtgagcggcggcgatcggcttcggatcggcgcagcgcggcggagcggagatggttgccgtggcggtggatggcctgatccgcggtgcggacgccgtgccggcggcggacaggtaagcggtgagggcggcagctgctgatgcggcggccaagggcggtgagggggaatcggggaaggaggaggtgagggagtatgagagcgacatgaggaagctggaggagctgctttctaagctgaacccctcggcggaggagttcttgcagtagtcccgccgccgcatggacggggggccaccacgcttttcgtccgacgcgccggggttcgagtcgccggcaattgactactaactggggccaccacaaggctccccaccgcacgcagcgtcgtgcagcaaacagccggggctactccacgtggctcccggttgggtgggcggtgctaagagcaggggcttggcaattggggtggagcgtgcgacgggggaattgagtcttttcatccgagctgaaacgtaatgtcggccttaatggagtctacacccctn

SEQ ID NO: 38806 - protein, 44 aa, Zea mays
  misc_feature: Ceres CLONE 1427903-F
  misc_feature (16)..(16): Xaa is any aa, unknown, or other
WRPPATQKEWGWVGGXFKMELHAVAAALDSKNPPGCRNFPETIT

SEQ ID NO: 38807 - DNA, 666 bp, Zea mays
  misc_feature: Ceres CLONE 1427904-F
  misc_feature: Encodes the peptide sequence at SEQ ID NO. 38808
  misc_feature (350)..(350): n is a, c, t, g, unknown, or other
tggagctccccgcggtggcggccgctctagaactagtggatcccccgggctgcaggaattcgcacgagaccattacctagaacatcctaatcgaaaaaaccttgcccctgctcctcacgccgccgccgccgccgccgtcgccgccacacatccgtagcgcccagccgccggagaagaggagggagccagcaccagcaccatgggtcgcgtccgcaccaagaccgtgaagaagacctccaggcggtgatcgagagtactactcccgcatgaccctcgacttccacaccaacaagagggtgctggaagaggtctcgatcctcccctcgaagcgcctccgcaacaaggttgcntgctttcacacccacctgatgcgccgggtgggggggggccccgtccgtggcatctcgctcaagctgcaggaggaggagcgggagccccgcatggacttcgccccggagaagtccgccctcgaggtccaagaaatccccgtcaacaaggagacccatggagatcctcccgggcctttggcatggcccatctcccgggggtaaaacccccaggttgaggtcttcaagcgtccccgcctaaggcccccccgaatagggagggccccccccgggaccgcttctaggtttccccgccaatcgcgggggtgtccgccgtggg

SEQ ID NO: 38808 - protein, 94 aa, Zea mays
  misc_feature: Ceres CLONE 1427904-F
  misc_feature (1)..(94): Pfam Name: Ribosomal_S17e Pfam Description: Ribosomal S17
MTLDFHTNKRVLEEVSILPSKRLRNKVACFHTHLMRRVGGGPVRGISLKLQEEEREPRMDFAPEKSALEVQEIPVNKETHGDPPGPLAWPISRG

SEQ ID NO: 38809 - DNA, 812 bp, Zea mays
  misc_feature: Ceres CLONE 1427905-F
  misc_feature (42)..(42): n is a, c, t, g, unknown, or other
ggggcccgcgggggggtatttatggggggggggggggtgccncccccaaactggagctccccgcggtggcggccgctctataactagtggatcccccgggctgcaggaattcgcacgagaccattacgtagaacatcctaatcgaaaaagcccacgcgctcgcctatctcatagtgcttcccgattccgcctctctagctggcctgtccaggcaccctcgccatcctccccaggcgcacgaccaaagggtcgggacccccagcggcggggctcgggtttgagtcgaagggcgccggcaccgccaccgccaccggcggtgatggcacggcgggagcgtaggagtatcgatctggaggagggacgggcgttgaggcagaagggtagcaccagggtgaagaacatccacgggggcaagccctgaccgtgtggtcggctgccagcagtacgtgatgctccacccccccctgttgggcatgtgcaggcggaagggcggtggactactactctcaacccctctacgacgggcctccggggacacgcgaggagtatgccacgtgcgtgctactagcgtcgctgacgcagcaccgggaggaaattatggcggagagggctagttggaaacgtgtgtcgacccatagactggtggttggtgtggggcccagcgtttggttcattacgcgtgccgccggtgcttgatcggccggggggctgctgtttgcccggacgttacaggacggctgggccgttatcttcgcctcccgcgacggggtggaaggttagtggtggcagtttggagagtcccacgtgctccg

SEQ ID NO: 38810 - DNA, 766 bp, Zea mays
  misc_feature: Ceres CLONE 1427905-R
  misc_feature: SWISSPROT Homolog: EC 2.7.4.3 Adenylate kinase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (709)..(709): n is a, c, t, g, unknown, or other
nnnnnaatcgggacaaccctcggggcgactgaatagataacctacagcatgtcttcatgcgctccaaactgtgtcccaagcaagaatgggctgcttagtgcttacagctatcgtaagttacatagtaccggctcaccatcaaaacgccggtggaaaccaacaaatcgctttttgacaagaaaaccattacttctgcataacgcactaaactatggagtaagtttcctcttctccattattcaaaaaaatgtggtatggtctttttcccagtatgtaggtcggtctcccagagacctacgctgcagctaacctcaactcatcttggtcctcgaggtttagaacctggagcagctttggccaagattcagggatcccaccaggcaagtcaaattccaagagcttcccctgctctcggtagaaaccttccacaggttgactcatgtcattatatatctgaagccgatttctgaccacctcttcggtatcatcagctcgggtaataagcttcgacatgcagttgtttgggggcaacagtggtgccatgtagattggtgggagtccattgtcacccttaacatcaatgcagggcaaattgaagttctttccacattggccgcataatcttctgccaaggcacttctctactataacagtctcctcttagtgtcagattaaccaccatatcaatggtctgtaacgccatcaaggnttttccgcttgttttactgttccggggaaaaaccatcaaggactaaatccctgattc

SEQ ID NO: 38811 - DNA, 666 bp, Zea mays
  misc_feature: Ceres CLONE 1427909-F
  misc_feature: Encodes the peptide sequence at SEQ ID NO. 38812
aagctggagctccccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggggaatttcttgcaagggactatcacgagcgcactatctacatcccacaacccaacctggggaaatccccccaaaagtctttcaccctatcctgcgtttgaactttagggacctccccctattatggaatcctgaaaaaatgcaacctttccttt

SEQ ID NO: 38812 - protein, 151 aa, Zea mays
  misc_feature: Ceres CLONE 1427909-F
  misc_feature: SWISSPROT Homolog: EC 2.6.1.1 Aspartate transaminase
MASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARDYHERTIYIPQPNLGKSPQKSFTLSCV

SEQ ID NO: 38813 - DNA, 673 bp, Zea mays
  misc_feature: Ceres CLONE 1427915-F
  misc_feature: Encodes the peptide sequence at SEQ ID NO. 38814
  misc_feature (399)..(399): n is a, c, t, g, unknown, or other
  misc_feature (408)..(408): n is a, c, t, g, unknown, or other
  misc_feature (431)..(431): n is a, c, t, g, unknown, or other
  misc_feature (435)..(435): n is a, c, t, g, unknown, or other
  misc_feature (441)..(441): n is a, c, t, g, unknown, or other
  misc_feature (450)..(450): n is a, c, t, g, unknown, or other
  misc_feature (452)..(452): n is a, c, t, g, unknown, or other
  misc_feature (454)..(454): n is a, c, t, g, unknown, or other
  misc_feature (459)..(459): n is a, c, t, g, unknown, or other
aaagctggagctccccgcggtggcggccgctctagaactagtggatcccccgggctgcaggaattcgcacgagaccattacctagaacatcctaatcgaaaaacaccaacaaaccaaacaccatccgccacgaccacgactccacgagagagcggaggaggagggggagcaatggcagagccgggccagcagttgctgcggtcgttcgtggaggtggcagcgggctcgcacttccctatccagaacctgcccttcggggtcttccgccggcgggggtcgccaccgcaggctccgctccccccggtggccatcggggacttcgcgctcgacctcgccaccgtcgccgacgcgggtctcttcgacgggcccgcgctctccggctgcccgtgcttcccacangagacgctncacatgttcttggggatgggccnaccngcgtgnaggggagcncncnccacnctacaaaaaatcctctcagccgacgagccagtcttgcgtgacaacgaagccctgaggaaataatgtcttattcaatgagtgatatcgagatggttcaccaatcacggttgggaggtacacagatttcttttgttctgtgcacatgcaagggactgctgattcatcttccgaggggcgcagactccagttaatcccaaattggttttatctccaa

SEQ ID NO: 38814 - protein, 116 aa, Zea mays
  misc_feature: Ceres CLONE 1427915-F
  misc_feature (11)..(117): Pfam Name: DUF1969 Pfam Description: Domain of unknown function (DUF1969)
  misc_feature: SWISSPROT Homolog: EC 3.7.1.2 Fumarylacetoacetase
  misc_feature (76)..(76): Xaa is any aa, unknown, or other
  misc_feature (87)..(87): Xaa is any aa, unknown, or other
  misc_feature (90)..(90): Xaa is any aa, unknown, or other
  misc_feature (94)..(94): Xaa is any aa, unknown, or other
  misc_feature (95)..(95): Xaa is any aa, unknown, or other
MAEPGQQLLRSFVEVAAGSHFPIQNLPFGVFRRRGSPPQAPLPPVAIGDFALDLATVADAGLFDGPALSGCPCFPXETLHMFLGMGXPAXRGAXXTLQKILSADEPVLRDNEALRK

SEQ ID NO: 38815 - DNA, 666 bp, Zea mays
  misc_feature: Ceres CLONE 1427924-F
  misc_feature: Encodes the peptide sequence at SEQ ID NO. 38816
  misc_feature (409)..(409): n is a, c, t, g, unknown, or other
ccaccgtcggtggcggccgctctagaactagtggatcccccgggctgcaggaattcgcacgagaccattacctagaacatcctaatcgagaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttccctccaacatcatcagccctattacatcagttacctttggntgcattattggcacaaaacatcatggcacaacaaactacacaactgtgctagcaaccttgctgcctactctcagcaacagcagtttctccaatccaacaactagctgcattgaaacctgcctcctatttgaaaaacaacaactacattttagcccggttcctggtggctaccccaaaaatttcttccattcaaccaaatggcagcattaacacccccggttttttaagggggaaaaactacttccattcgcgccggt

SEQ ID NO: 38816 - protein, 103 aa, Zea mays
  misc_feature: Ceres CLONE 1427924-F
  misc_feature (87)..(87): Xaa is any aa, unknown, or other
MAAKIFCLLMLLGLSASAATATIFPQCSQAPIASLLPPYLSPAVSSVCENPILQPYRIQQAITAGILPLSPLFPPTSSALLHQLPLXALLAQNIMAQQTTQLC

SEQ ID NO: 38817 - DNA, 763 bp, Zea mays
  misc_feature: Ceres CLONE 1427925-F
  misc_feature: Translation starting site: 597
aaagctggagctccccgcggtggcggccgctctagatccgtggatcccccgggctgcaggaatttgcacgagaccattacctagaacatcctaatcgaaaaatcccttagcctgacgcttgtgctgccgctgccagcgcacatgtccgccgccccgatcccgccgcgtggttatctgcagcggatcgcgtggtagggtgcgtgcacggacaacttcctcggcaaccatgccgcgtctcccaccgtcccgacgctctgggagaggtgcaccccggcatgcgccccctccgggaaagccagcggtttcctagcgctggactggtgcgactccaccccagtgctgtccaggctcccgcaggcctccttcagtctcccccgtcgcctggacgacgccatcagcaagacctacgcctacggtattccccccgtgaggacgatctcgatactggattccccgtactccaccgcctactccgctaaaccaggccaccctctgatagccggcctgagcacagaccttcctatctaccgcttgtgatccgtgcatctcttggaaaaattcacgcttgccaacttcatcgatccattccctccttcatgatcgtgccacgaactgactgtacctcaagcaaaagtccttttattgctctccattgcctggtgcaaaccactaggaactgggaaaaagagcccaacttctccctaaacattagaagacggccgagccaaagcgttcgcgagagatccccaattacaaacttact

SEQ ID NO: 38818 - DNA, 653 bp, Zea mays
  misc_feature: Ceres CLONE 1427935-F
  misc_feature: Encodes the peptide sequence at SEQ ID NO. 38819
  misc_feature (540)..(540): n is a, c, t, g, unknown, or other
  misc_feature (541)..(541): n is a, c, t, g, unknown, or other
  misc_feature (551)..(551): n is a, c, t, g, unknown, or other
  misc_feature (603)..(603): n is a, c, t, g, unknown, or other
  misc_feature (624)..(624): n is a, c, t, g, unknown, or other
ccgctctagtactagtggatcccccgggctgcaggaattcgcacgagaccattacctagaacatcctaatcgaaaacttttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatgccacccgtatggnntccgctggtngtgtgaggaagcagggcgtggatatctcacccctgaggagggtgaaacaggncatctacctcctcacactggntgcagggagagtgctttccggaacatcaa

SEQ ID NO: 38819 - protein, 161 aa, Zea mays
  misc_feature: Ceres CLONE 1427935-F
  misc_feature (44)..(161): Pfam Name: Ribosomal_S7 Pfam Description: Ribosomal protein S7p/S5e
  misc_feature (124)..(124): Xaa is any aa, unknown, or other
  misc_feature (128)..(128): Xaa is any aa, unknown, or other
  misc_feature (145)..(145): Xaa is any aa, unknown, or other
  misc_feature (152)..(152): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRMXSAGXVRKQGVDISPLRRVKQXIYLLTLXAGRVLSGTS

SEQ ID NO: 38820 - DNA, 664 bp, Zea mays
  misc_feature: Ceres CLONE 1427948-F
  misc_feature: Encodes the peptide sequence at SEQ ID NO. 38821
  misc_feature (524)..(524): n is a, c, t, g, unknown, or other
  misc_feature (530)..(530): n is a, c, t, g, unknown, or other
  misc_feature (532)..(532): n is a, c, t, g, unknown, or other
  misc_feature (533)..(533): n is a, c, t, g, unknown, or other
  misc_feature (551)..(551): n is a, c, t, g, unknown, or other
  misc_feature (603)..(603): n is a, c, t, g, unknown, or other
tccccgcggtggcggccgctctagaactcgtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggccgaggcccccgcgtacctgcaccgcgacgacttcgcgcggtacctggacgggtacgccgcgcggttcgccgtccgcccgcgcctccgccgcgaagtccggtcggcgcggtacgaccccccnaagccncnngtggaagtggaaggcccntggacctcggcacgggccaggccgaagcggtacgcggcgaaggttcttgggnggtcccctcccggggaaaaacgcccaagaaattccctgcccgaaggtccctgggcttggag

SEQ ID NO: 38821 - protein, 157 aa, Zea mays
  misc_feature: Ceres CLONE 1427948-F
  misc_feature (114)..(114): Xaa is any aa, unknown, or other
  misc_feature (138)..(138): Xaa is any aa, unknown, or other
MAAVAEEEVIVVGAGQSGLAVAACLSLRGVRALVLERDDCVGSLWRKRAYDRLHLHLTKKYCALPHAPHPAEAPAYLHRDDFARYLDGYAARFAVRPRLRREVRSARYDPPKPXVEVEGPWTSARARPKRYAAKVLGXSPPGEKRPRNSLPEGPWAW

SEQ ID NO: 38822 - DNA, 625 bp, Zea mays
  misc_feature: Ceres CLONE 1427954-F
  misc_feature: Encodes the peptide sequence at SEQ ID NO. 38823
  misc_feature (341)..(341): n is a, c, t, g, unknown, or other
  misc_feature (524)..(524): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgncggtccacctgccgccgccgggtcacctgccaccgccggtccatgtgcccgcgccgggtcatctgccgcccccaccatgccactaccctactccaccgccccgggctcagcctcatcccccagcacacccatgcccgtgccaacagccgcatccaagcccgtgccagctgcagggaacctgcnngcgtggcagcaccccgatccctggccagtgcgtcgagtccctgaaggatcagtggagcccgacggcgacccctactgctcgcctagtgccagtgttgcgg

SEQ ID NO: 38823 - protein, 51 aa, Zea mays
  misc_feature: Ceres CLONE 1427954-F
  misc_feature (18)..(18): Xaa is any aa, unknown, or other
MPVPTAASKPVPAAGNLXAWQHPDPWPVRRVPEGSVEPDGDPYCSPSASVA

SEQ ID NO: 38824 - DNA, 614 bp, Zea mays
  misc_feature: Ceres CLONE 1427960-F
  misc_feature: Translation starting site: 122
  misc_feature: SWISSPROT Homolog: EC 3.6.3.14 H(+)-transporting two-sector ATPase
  misc_feature (369)..(369): n is a, c, t, g, unknown, or other
  misc_feature (372)..(372): n is a, c, t, g, unknown, or other
  misc_feature (374)..(374): n is a, c, t, g, unknown, or other
  misc_feature (375)..(375): n is a, c, t, g, unknown, or other
  misc_feature (417)..(417): n is a, c, t, g, unknown, or other
  misc_feature (452)..(452): n is a, c, t, g, unknown, or other
caaagctggagctccccgcggtggcggccgctctagaactagtggataccccgggcttgcaggaattcgcacgagaaccattacctaaaacattcctaatcgaaaaaatcggagagcaattatggcttcaggtttcagcggcgatgaaacttgcttccttttcttcggaatcctcggcgctgccgccgctctcgttttctcatgtatgggagcagcgtacgggacagcgaagaagcggggtcggcgtggcgtcaatgggtgtgatgagaccagagcttgtgatgaaatcgatttgtccgtggtcatggctgggtgtgtaggtatctatggtctcatcattgctgtcatcatcagtactggaatcaaccntangnncagtcttactacgtcgtcggacggctatgctcatctctcttnccgtctcgcttggtgtctcgcccgtctcctcgccnggattgctattgggtatcgtccgccaaccctggtggttaaaacaaatgcccaaccacccaaacttgtttgtgggaaaggattttgaattccccatcgtggcggaaaaccctttggcctttaacggccccaattgttggaaaacaacccccccggccccgggg

SEQ ID NO: 38825 - DNA, 725 bp, Zea mays
  misc_feature: Ceres CLONE 1427965-F
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
ttttttttttttgtccccccctttcctctttttnntnttatttttttggtaattggttcaaactggagctccccgcggtggcggccgctctagaactagtggatcccccgggctgcaggaattcgcacgagaccattacctagaacatcctaatcgaaaaagtatgtttgagcaaaaaaggataggaatccttcttgtgtctctggccgagccgccgtccttgccgccgtccagatttggagaaagagatacgggaccatagattcgactcgaagaggacgccagttgctacatggcgcgggcgatgaacaccgctgagaagtccactggaggaaaggctcatacgaagcaactcggtaccgaggcagtccggatgtctaggcaccacaactggaggaatagaagaagcctcggcgtggaggcccagggactgtagctcttcacaagaaccgcaagtaccataaaagccctgactttctggataacgaagctgccagtgcagagagttgtgagggacattgctcaggattgccaaaccgatctgcgcttccatagccatgcctggcttgcatccgcaggaagccacacacgcctacctggtatggtctcttcgcaagaacccagttctgtggcgcgggtcgatgcgaaaatcgcaagatccatgcctgccccaaggggacatctcaggcttgggcaaaaaaggtggcccccgtggcggaggagtg

SEQ ID NO: 38826 - DNA, 716 bp, Zea mays
  misc_feature: Ceres CLONE 1427970-F
  misc_feature: Encodes the peptide sequence at SEQ ID NO. 38827
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (31)..(31): n is a, c, t, g, unknown, or other
  misc_feature (32)..(32): n is a, c, t, g, unknown, or other
  misc_feature (38)..(38): n is a, c, t, g, unknown, or other
ttttttttctttttttttnnnccanagggannggaagntgttttcccccctcttatacctggagctccccgcggtggcggccgctctataactagtggatcccccgggctgcaggaattcgcacgagaccattacctagaacatcctaatcgaaaaaaatctgccaatttgtccgaggcccatctccataaaaccctaatccacggccgcggcatccagccctgcgcccccgcccgcttgctcgcctccacccgcggtcgcggcctccagtgcccagcgccaccgccgcttgtcagcctccacctttgagcctgttcctgagtcaagtgtctctcgtggccacaggacggctacatcgacctctacgggccctacgataaggttcttctcaactgctcagggggcagcgtgtgcgggacctgcatcgtcgaggtggttgaaggcaaggaaatgttgtccccgaaaactaacgccgaaaaggagttgctcaaaaggaaacccaagacgtggagattggcgtgccaggcaacggtgggcaacgcagattcgactggacaaatgatcattcaacagttgccgaagtggaagatacacgagtgggacaagtaggggttactgctttactggtcttcaagagtgctcctcgtggccatacctataaattacatggcagtggaaatggggaaaaaaaagaaataagaagcaacctgaatccc

SEQ ID NO: 38827 - protein, 52 aa, Zea mays
  misc_feature: Ceres CLONE 1427970-F
MLSPKTNAEKELLKRKPKTWRLACQATVGNADSTGQMIIQQLPKWKIHEWDK

SEQ ID NO: 38828 - DNA, 714 bp, Zea mays
  misc_feature: Ceres CLONE 1427971-F
  misc_feature: Encodes the peptide sequence at SEQ ID NO. 38829
  misc_feature (714)..(714): n is a, c, t, g, unknown, or other
agctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaggctctgaagtcccctttgatgggcctattcgagaagcgcagagcaaggaacttcttcatttatgtccaagattacaatgaagctgatccaaggacacatcaaggattggaccttactagggtgacaactagagaacttatagcaaaatatggtttaagtgatgatacagtggn

SEQ ID NO: 38829 - protein, 181 aa, Zea mays
  misc_feature: Ceres CLONE 1427971-F
  misc_feature (1)..(180): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRTHQGLDLTRVTTRELIAKYGLSDDTV

SEQ ID NO: 38830 - DNA, 738 bp, Zea mays
  misc_feature: Ceres CLONE 1427972-F
  misc_feature: Encodes the peptide sequence at SEQ ID NO. 38831
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
ggaggggggggnnnnnttgggcgcgccgtgggttggcggcgggtgcgggctgtgaaaaaaagtaaaaactggagctccccgcggtggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcagcggcgccctactacgccgggtgtgggcagccgagcgccatgttccaaccggctccggcaacgggtgctgccagcagcagatgaggatgatggacgttgaatccgtcacgcagccgctgccaatgaaggatgcaacttgggggtgccccttcccccggccagatcccggcacgaagacacctctgaatgacacaaccgccaataggtggctgggcagccccaaggggtacaaacccccatggggcactgaaggaagggcccaaaaaagcgtggccggacccctggggtggggaattctcaccaggatacccagacgtgcc

SEQ ID NO: 38831 - protein, 92 aa, Zea mays
  misc_feature: Ceres CLONE 1427972-F
MKMVIVLVVCLALSAASASAMQMPCPCAGLQGLYGAGAGLTTMMGAGGLYPYAEYLRQPQCSPLAAAPYYAGCGQPSAMFQPAPATGAASSR

SEQ ID NO: 38832 - DNA, 777 bp, Zea mays
  misc_feature: Ceres CLONE 1427981-F
  misc_feature (14)..(14): n is a, c, t, g, unknown, or other
  misc_feature (694)..(694): n is a, c, t, g, unknown, or other
ttcccccccctggntttgtgttggtgtgccccgcttgtgtgtgtccccctcttcaaaactggactcaccgcggtggcggccgctctagaactagtggatcccccgggctgcaggaattcgcacgagaccattacctagaacatcctaatcgaaaaagtcagatccgtgttccgtgtccgcgtccagtgtgtccgctactccgctccccctcagtcctcagtttcctcacctaacgggtaaccttggccccccggaaaaacattaaatgggcggctttctgaaggggggaaccgggggggggaaaccaccggggcacccccacagagggggagggggatatccgggatccccacccccccggggggaggggggggggcccccccccctcctcccgcgcgggcgcccccccccccccccccccctacaaaataaccgagggggggggggggggtggggggtgataatttttctctcctaaacacgaacaaccgccggcggcccccccccccacctcgccctcgtacttcaggcacacacctcatgtgggtcccaccgcccggaacgaactcgtcttgtacaccccccgaaataaacagccccgccagagctatcaaaaaagccgccgttcccccccctcgggcaccccccccgcacaagcgccccatggtttatatagagaatatatttatagaanattggtaattttttttgtttcggtgtgggtgggggtggccccccccccctgcgcccaatcgtcgtctgtccccgggcccacca

SEQ ID NO: 38833 - DNA, 733 bp, Zea mays
  misc_feature: Ceres CLONE 1427987-F
  misc_feature: Encodes the peptide sequence at SEQ ID NO. 38834
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (30)..(30): n is a, c, t, g, unknown, or other
nttttttnnnnnnnnnnnnnntttcttcgncttttttttgtttctcatccgcagctcaaactgggactccccgcggtggcggccgctctagaactagtggatcccccgggctgcaggaattcgcacgagaccattacctagaacatcctaatcgaaaagatttcgattctttctttttcccccacgtgcgccgccgcgaccttcctcgatcccatctcccaacgcccccgcctcgcctcgggatcccgccgccgctccatctgcctttgctcccccacccgcaggcagcgagcgacagcgacggcgagggatggccaaggccaggtcgttggcgaagcagaagcaggcgcagcaatcaaacggcggcggcggccacgcgctgtcctccaagctcgcccggtacctcgacccggaggcctccttggacaaggaccaactgctggacgcggtgcactggatccgccaggcggtggggctcatatgcggcctgctctggggagccgtccccctcgtcggcgccgtctggatcgccactatttatggccatctcgactggcattatctatttggtactacacctactttgctgaaggttgacgaaggaggaatatggaggccctgggggcggcttctttcaggaagggtctttttcgctttcatttcacccttttttcccggcttttcggtgtaactccttaggtataactaggtctgggcttcaccttccctgaac

SEQ ID NO: 38834 - protein, 126 aa, Zea mays
  misc_feature: Ceres CLONE 1427987-F
  misc_feature (18)..(126): Pfam Name: Rab5ip Pfam Description: Rab5-interacting protein (Rab5ip)
MAKARSLAKQKQAQQSNGGGGHALSSKLARYLDPEASLDKDQLLDAVHWIRQAVGLICGLLWGAVPLVGAVWIATIYGHLDWHYLFGTTPTLLKVDEGGIWRPWGRLLSGRVFFAFISPFFPGFSV

SEQ ID NO: 38835 - DNA, 680 bp, Zea mays
  misc_feature: Ceres CLONE 1427989-F
  misc_feature: Translation starting site: 210
  misc_feature (434)..(434): n is a, c, t, g, unknown, or other
  misc_feature (543)..(543): n is a, c, t, g, unknown, or other
  misc_feature (549)..(549): n is a, c, t, g, unknown, or other
  misc_feature (550)..(550): n is a, c, t, g, unknown, or other
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaactcacaaaaccctcgccagcttatcccccttccctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagttctgcaagaatattgttctagctggagttggaagtttatccttgatggatgataatgtagtcacagaggaggatctgaatgcaaatttcttaattcctcctgatgagagcatatatnggtggtagatctcgagcccaagtttgctgcgagtctttgatagatttcaatcctatggttagagtttctgttgaaaagggtgatccatcattaattgatggagaatccnttgacnnagtcgacattgttgtacttagccgtgcatctcttaaaacaanttgttgattaaatgaaactgtcgaaagagagcaaacatattgcattttatactatagattgcaaggattcatgtggtgaaaatatttg

SEQ ID NO: 38836 - DNA, 686 bp, Zea mays
  misc_feature: Ceres CLONE 1427993-F
  misc_feature (686)..(686): n is a, c, t, g, unknown, or other
aaagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctcgatgctctccccatcgacacgn

SEQ ID NO: 38837 - DNA, 716 bp, Zea mays
  misc_feature: Ceres CLONE 1428004-F
  misc_feature: Encodes the peptide sequence at SEQ ID NO. 38838
  misc_feature (36)..(36): n is a, c, t, g, unknown, or other
  misc_feature (40)..(40): n is a, c, t, g, unknown, or other
ttttttcgcctctctcttttttccgtgcggcgccgngggngggagataaattcaaactgggactccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcccggagcggctgctccgcctgctggcgtcccgcggcgttttctccgagtccaccgagtccacgcccaccacgcggcggcggctattcgcgctcaccgcggtgggccgcaccctggtgccggggcccgcctcgggcgcgtcctacgccgactacgtgctgcagcaccaccaggacccgcttggtggcggcgtggccccgccctgcacaaggccggtgcttgaccccgggagggcccgaacccattcc

SEQ ID NO: 38838 - protein, 160 aa, Zea mays
  misc_feature: Ceres CLONE 1428004-F
  misc_feature: SWISSPROT Homolog: EC 2.1.1.68 Caffeate O-methyltransferase
MPPPSANGATAAAAAARDDMSPAEARLAMMELANMVSVPMALAAVIRLGVPAAVWAGGANAPMSAADLLPPGHPDPSVPERLLRLLASRGVFSESTESTPTTRRRLFALTAVGRTLVPGPASGASYADYVLQHHQDPLGGGVAPPCTRPVLDPGRARTHS

SEQ ID NO: 38839 - DNA, 667 bp, Zea mays
  misc_feature: Ceres CLONE 1428011-F
  misc_feature: Encodes the peptide sequence at SEQ ID NO. 38840
gctcttaactagtggatcccccgggctgcaggaattcgcacgagaccattacctagaacatcctaatcgaaaaaaggcaactcagccaagctcgtgagagcagaggaactctctttcctcacactccaaagcagcaagaccatctggcaaagctgcgctagaggccagcatcaggccataataggccagagagcagacgaggcatggcgacgtccgtggcctgcgccttcttcttcttcgacgcggcggagccgctgggcgagggcgggcggcggcggcagcggcaagcgctggacgcctgcgcgctctgctccaagccgctggcccgcaacagcgacatcttcatgtacaggggcgacaccccgttctgcagcgaggactgccgctaccagcagatgcaccacgacgcggcggccacggcctacgcgcggcatcgggccagcacccggcggaggcagcagcggagcagggggcggctctgtgtccaccaacaaggccggacgtgtacgtggccagctagagtaaaagcaaacgcaagtgtcaagcgccggctaggcccaagaaaggatgaagggccgtcccccctcccctggttcaaaacaagaagaatcccccccccggctggaggtgggaagggcccaagggcccctgggcccctccacggggt

SEQ ID NO: 38840 - protein, 154 aa, Zea mays
  misc_feature: Ceres CLONE 1428011-F
  misc_feature (16)..(72): Pfam Name: DUF581 Pfam Description: Protein of unknown function (DUF581)
MATSVACAFFFFDAAEPLGEGGRRRQRQALDACALCSKPLARNSDIFMYRGDTPFCSEDCRYQQMHHDAAATAYARHRASTRRRQQRSRGRLCVHQQGRTCTWPARVKANASVKRRLGPRKDEGPSPLPWFKTRRIPPPAGGGKGPRAPGPLHG

SEQ ID NO: 38841 - DNA, 758 bp, Zea mays
  misc_feature: Ceres CLONE 1428019-F
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
ttgttgtggggtggncnnncccccctcaactcgggccgcggggcgtcgcgtgagcggcccaagctggaactcccccctgtggcggccgctctagaactgtggatcccccgggctgcaggaattcgcacgagaccattacctagaacatcctaatcgaaaaattgggagctcactcggtggtcgttgcctgctgcggattgcccccaggcggccccactcactccgctgttgatatttcgtttggttctcctttccgtcttgtccgtcgccgagggcttcttcccctcgctccccagctccagcaggcagatcaaatccatccatccacgaacaggaaggtgagcgccgggtaacgagccctcgggcctcctactagctgcgatccgaagccatggcggcgctttcgcgcctggtctaaatcgccacggtctagatctgcggtgttttactatccagggcgccggtggcccaatcctctccctccgcggaggagagctcggtcgccttggctttgattaaggtcggtctcccccggtgtccgtggatacttgatatacattccgggaatcggggccaggctggaaatcacaaggaaggtcttgaaggccttgaaggggctgtaagatagaacccagggagtgccgggccgcggggtttcgaccgtgtcggcttaaaacgctaaaagaggggcacatactccttacttaacacccgcccggacgaacccaactgaacataaacggcccacgcggacacct

SEQ ID NO: 38842 - DNA, 673 bp, Zea mays
  misc_feature: Ceres CLONE 1428028-F
  misc_feature: Encodes the peptide sequence at SEQ ID NO. 38843
aagctggagctccccgcggtggcggccgctctataactagtggatcccccgggctgcaggaattcgcacgagaccattacctagaacatcctaatcgaaaagtaaaaatcaaatccaagacaaaacagacgatgagcttcactacatctctcatctcctctctggcttctcctccgtctctcgtccctccccacgatcttcctcctttcttctccctcagaaacacagtcctgaagccaacaatcgccactcgtacacgtcgacaactgttcccatcctcttgtctggctgcaaaagcagccacgtcgccgtcggagacagccaacgacgttgtcctcgaaacagctccgacaccagcgcatgaggtcgtctccagcttctacgccgccatcaacgtccatgacttatcctccgtcacagacctcatagctcaggactgcctctacgaggatctcgtcttctcttcccctttcgttggccgaacggcgattctggacttcttcgggaagttcatcgaagcaacgagtacggatcttcagttcgtgatagatgacatttccaaagaggactcttcagctgttggcgtttcatggcatttagaatggaaaggcaagaacttcccgtttagtaaaggttgcagcttttacaagcttgaagttattgatggcaagag

SEQ ID NO: 38843 - protein, 180 aa, Zea mays
  misc_feature: Ceres CLONE 1428028-F
  misc_feature (75)..(180): Pfam Name: NTF2 Pfam Description: Nuclear transport factor 2 (NTF2) domain
  misc_feature: SWISSPROT Homolog: EC 5.3.3.1 Steroid Delta-isomerase
MSFTTSLISSLASPPSLVPPHDLPPFFSLRNTVLKPTIATRTRRQLFPSSCLAAKAATSPSETANDVVLETAPTPAHEVVSSFYAAINVHDLSSVTDLIAQDCLYEDLVFSSPFVGRTAILDFFGKFIEATSTDLQFVIDDISKEDSSAVGVSWHLEWKGKNFPFSKGCSFYKLEVIDGK

SEQ ID NO: 38844 - DNA, 663 bp, Zea mays
  misc_feature: Ceres CLONE 1428029-F
  misc_feature: Encodes the peptide sequence at SEQ ID NO. 38845
  misc_feature (1)..(1): n is a, c, t, g, unknown, or other
  misc_feature (413)..(413): n is a, c, t, g, unknown, or other
  misc_feature (543)..(543): n is a, c, t, g, unknown, or other
  misc_feature (546)..(546): n is a, c, t, g, unknown, or other
  misc_feature (565)..(565): n is a, c, t, g, unknown, or other
  misc_feature (648)..(648): n is a, c, t, g, unknown, or other
naaagctggagctccccgcggtggcggccgctctagaactagtggatcccccgggctgcaggaattcgcacgagaccattacctagaacatcctaatcgaaaattcaccttggctgcagcctgcaacacaatcctacgcttccgacttcaacgcgcgcccctcccattttcacctagccctactcctttgtacataaaggaagatgggagcatatgcaacgactggtatgcagatgatagcaacacgcccttccatcccggcctacaggcaaatacttgggtcgacatcagcactatctgcatttggaaggtcaatctgttccagaactggctttgccatctcttctaaagccacatcagcaggaccactggtttcttcgaattgcaagagggttgttgtgagggcaatgtcncagaagagtgcccaaggacttcccattgatctcacaggtaaaagagcatttatagctggagttgcaatgaataatggttatggttgggcaattgctaaggctcttgctgctgctggtgctgagattcttngtngtacatgggtgcctgcttngaacatatttgagacaggcttgagacgtggaaggttgatgaatcaccgaagctactgatggatctcttatggagattgctaangtatatcactggacg

SEQ ID NO: 38845 - protein, 139 aa, Zea mays
  misc_feature: Ceres CLONE 1428029-F
  misc_feature: SWISSPROT Homolog: EC 1.3.1.9 Enoyl-[acyl-carrier-protein] reductase (NADH)
  misc_feature (114)..(114): Xaa is any aa, unknown, or other
  misc_feature (115)..(115): Xaa is any aa, unknown, or other
  misc_feature (121)..(121): Xaa is any aa, unknown, or other
MGAYATTGMQMIATRPSIPAYRQILGSTSALSAFGRSICSRTGFAISSKATSAGPLVSSNCKRVVVRAMSQKSAQGLPIDLTGKRAFIAGVAMNNGYGWAIAKALAAAGAEILXXTWVPAXNIFETGLRRGRLMNHRSY

SEQ ID NO: 38846 - DNA, 688 bp, Zea mays
  misc_feature: Ceres CLONE 1428038-F
  misc_feature: Encodes the peptide sequence at SEQ ID NO. 38847
  misc_feature (399)..(399): n is a, c, t, g, unknown, or other
caaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcaggggtgtggcgacaatcnccaggcctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttcatttaaccattggccgcactgaaccccgctgcttatttggagcacaaatac

SEQ ID NO: 38847 - protein, 172 aa, Zea mays
  misc_feature: Ceres CLONE 1428038-F
MATKIFSLLMLLALSACVANATIFPQCSQAPIASLLPPYLPSMIASVCENPALQPYRLQQAIAASNIPLSGVWRQSPGLSLVQSLVQTIRAQQLQQLVLPVINQVALANLSPYSQQQQFLPFNQLSTLNRAAYLQQQLLPFSQLATAYSQQQQLLHLTIGRTEPRCLFGAQI

SEQ ID NO: 38848 - DNA, 623 bp, Zea mays
  misc_feature: Ceres CLONE 1428039-F
  misc_feature: Encodes the peptide sequence at SEQ ID NO. 38849
  misc_feature (358)..(358): n is a, c, t, g, unknown, or other
  misc_feature (364)..(364): n is a, c, t, g, unknown, or other
  misc_feature (415)..(415): n is a, c, t, g, unknown, or other
  misc_feature (451)..(451): n is a, c, t, g, unknown, or other
aagctggagctccccgcggtggcggccgctctagaactagtggatcccccgggctgcaggaattcgcacgagaccattacctagaacatcctaatcggaaagttcctgttcccctcggcgacgccagtacggcagtacgccacgccagtgcccagttgcattgactcctccccggtccccacatcttgccgccaatggatgtcgacgggcccgcccccgccgacgcctctgccaggcccgccaccaacggcgaggccccctccggcgcccgcgaggtcgacgtcggcgaagaggacacgctcgccggcgtcctccgcagcttcgtcgacggcgtctggtacccggacgagcctctgcntccgcngctccgggcggcgtcctgcgacgccgcgccgcgcctgaagggggcgtcccngaaactcgcgcggggacctgcttgagtggaccaggncggggcagcggcctccgcgccatcctcgtattttcgggcgggaaaatcagctttaaggcaatgactgccctttcgaaccttcgggttctttcaaatgggtgcccccgggtaaagggaaaaattgtccccactcttttagatccccgggccccccccccaagaaaagtttttt

SEQ ID NO: 38849 - protein, 81 aa, Zea mays
  misc_feature: Ceres CLONE 1428039-F
  misc_feature (55)..(55): Xaa is any aa, unknown, or other
  misc_feature (57)..(57): Xaa is any aa, unknown, or other
  misc_feature (74)..(74): Xaa is any aa, unknown, or other
MDVDGPAPADASARPATNGEAPSGAREVDVGEEDTLAGVLRSFVDGVWYPDEPLXPXLRAASCDAAPRLKGASXKLARGPA

SEQ ID NO: 38850 - DNA, 635 bp, Zea mays
  misc_feature: Ceres CLONE 1428046-F
  misc_feature: Encodes the peptide sequence at SEQ ID NO. 38851
  misc_feature (49)..(49): n is a, c, t, g, unknown, or other
  misc_feature (58)..(58): n is a, c, t, g, unknown, or other
  misc_feature (64)..(64): n is a, c, t, g, unknown, or other
  misc_feature (65)..(65): n is a, c, t, g, unknown, or other
aactggactccccgcggtggcggccgctctagaactagtggatcccccngggctgcanggaatnntcgcacgagaccattacctagaacatcctaatcgaaaaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgccctccgttctatctgcccgcgcagcagcagccgcagccatgggcaataccccactcaaccaccgcagcttagccccgtgcccagcagttcggaatccctgcggcggtcggcagcggtcggcagccccgttcctggggccagtggcttcaaggttcctgaagcccccatttgcacccccgggggggggaccccctaagggttccccacatggcagggcccttcacaaacagggctccccccccaataaagggggggggggaacccccttccccgggtaccaaggggaaaataaggggggggggccctggaaggcccttttcctgggaaaaaaaaaccccccggggggggaa

SEQ ID NO: 38851 - protein, 158 aa, Zea mays
  misc_feature: Ceres CLONE 1428046-F
MKVLIVALALLALAASAASSTSGGCGCQTPPFHLPPPFYMPPSVLSARAAAAAAMGNTPLNHRSLAPCPAVRNPCGGRQRSAAPFLGPVASRFLKPPFAPPGGGPPKGSPHGRALHKQGSPPNKGGGGTPFPGYQGENKGGGPWKALFLGKKNPPGGE

SEQ ID NO: 38852 - DNA, 754 bp, Zea mays
  misc_feature: Ceres CLONE 1428048-F
  misc_feature: Translation starting site: 206
  misc_feature (337)..(337): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacngcgtcgcaggcgctgacggtggtgacgctgttcccccgctggcggctgctgctggtgctgtcggggctggcgctgaacgcctccgtggtggggctggccgtggccaccccggtgttctgattctcagcccgtgctcgtccccggggcgctgctcatcgggaacggcgtcatggggttcctcaactccggccccctggggttcggggggctttcccccttcaggggccctcccaaacggggggggaaggggttccacccccccccggaattctggggaaaagccccccccacggatggaaaaaggcccggcccacccgggcaacaaaaccccgggggggggccggcctttctgggggggggccaaaaaacccccccccgggaaaaagaaaaggcccccccttcgggcgcggaaaattt

SEQ ID NO: 38853 - DNA, 667 bp, Zea mays
  misc_feature: Ceres CLONE 1428050-F
  misc_feature: Encodes the peptide sequence at SEQ ID NO. 38854
  misc_feature (340)..(340): n is a, c, t, g, unknown, or other
  misc_feature (561)..(561): n is a, c, t, g, unknown, or other
  misc_feature (579)..(579): n is a, c, t, g, unknown, or other
aagctggagctccccgcggtggcggccgctctagaactagtggatcccccgggctgcaggaattcgcacgagaccattacctagaacatcctaatcgaaaaacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactcntgttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaaagaccaagacccctggacctggtgcccagtctgccctcagggcgcttgctcggtccgggatgaaatcngacgcattgaggacgttnccccggtccccactgacagcactccaagaaagggcggttagggggggaaggagctttaaccttctcctctgcgtggcatttgccgctc

SEQ ID NO: 38854 - protein, 144 aa, Zea mays
  misc_feature: Ceres CLONE 1428050-F
  misc_feature (28)..(144): Pfam Name: Ribosomal_S11 Pfam Description: Ribosomal protein S11
  misc_feature (52)..(52): Xaa is any aa, unknown, or other
  misc_feature (126)..(126): Xaa is any aa, unknown, or other
  misc_feature (132)..(132): Xaa is any aa, unknown, or other
MSRRKTREPKEENVTLGPTVREGEYVFGVAHIFASFNDTFIHITDLSGRETXVRITGGMKVKADRDESSPYAAMLAAQDVAQRCKELGITALHIKLRATGGNKDQDPWTWCPVCPQGACSVRDEIXRIEDVXPVPTDSTPRKGG

SEQ ID NO: 38855 - DNA, 673 bp, Zea mays
  misc_feature: Ceres CLONE 1428065-F
  misc_feature: Translation starting site: 167
  misc_feature (491)..(491): n is a, c, t, g, unknown, or other
aaagctggagctccccgcggtggcggccgctctagaactagtggatcccccgggctgcaggaattcgcacgagaccattacctagaacatcctaatcgaaaaagctggagggcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtaaaacgcgcgcgcgtgcgcctgtgctgcctgatccggatgcgcgcctaattaatctgccgcatatgcgcgcctttctgggttttactttgcaggtgggcggagctggagagcggggcaacgaccatcgcgttcacgccgctgcaccagcgggagacggacgacctgtcggggggcggtgcagctgccgaactcgntcggccgccggccggggctcctggaggtctgcttcgcctacgcggacgtcgaccccccgtaacagcgccgccgtggacaccggggcgtggcccttaaccccgccgaagaacaaccctgggggcacaagtcccgcttcctgccggacatgaccggaacctccggccgctcccgagctacgtga

SEQ ID NO: 38856 - DNA, 695 bp, Zea mays
  misc_feature: Ceres CLONE 1428068-F
  misc_feature: Encodes the peptide sequence at SEQ ID NO. 38857
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (33)..(33): n is a, c, t, g, unknown, or other
  misc_feature (50)..(50): n is a, c, t, g, unknown, or other
  misc_feature (695)..(695): n is a, c, t, g, unknown, or other
aaactggactccccgcgtcggcggnngnctagngtcgtgaccgcctggcngaggattttgcaatcagagggtagaaatccaatcgaaaaacctccgaatttagtgatccattcatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactacggccgcgcgctcgcgctccccggggtctgccgcgtcgccaccccggccgtctccacctaaacaaaaaan

SEQ ID NO: 38857 - protein, 136 aa, Zea mays
  misc_feature: Ceres CLONE 1428068-F
  misc_feature (58)..(135): Pfam Name: Tryp_alpha_amyl Pfam Description: Protease inhibitor/seed storage/LTP family
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADSYGIAVDYGRALALPGVCRVATPAVST

SEQ ID NO: 38858 - DNA, 725 bp, Zea mays
  misc_feature: Ceres CLONE 1428069-F
  misc_feature: Encodes the peptide sequence at SEQ ID NO. 38859
  misc_feature (145)..(145): n is a, c, t, g, unknown, or other
  misc_feature (358)..(358): n is a, c, t, g, unknown, or other
  misc_feature (379)..(379): n is a, c, t, g, unknown, or other
  misc_feature (380)..(380): n is a, c, t, g, unknown, or other
  misc_feature (447)..(447): n is a, c, t, g, unknown, or other
  misc_feature (448)..(448): n is a, c, t, g, unknown, or other
  misc_feature (453)..(453): n is a, c, t, g, unknown, or other
  misc_feature (462)..(462): n is a, c, t, g, unknown, or other
  misc_feature (469)..(469): n is a, c, t, g, unknown, or other
aagctggagctccccgcggtggcggccgctctagaactagtggatcccccgggctgcaggaattcgcacgagaccattacctagaacatcctaatcgaaaaactcgcctcgacgcgcctctgaaagttcggagccgccggcccgntccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagccntttggggccctttcatgtctnngtagcgtgggcatcatgtcccagtgatgcagaccccgctctgtgctaatgctcctgctgagaaaganngcagnaactcatgnatgattncatgatggggcgtgtttcagctgctgtttcaagactgctgctgctcccatcgaggctggtgagctgcttatttgaaacaggataagtgtttagtcctggaaggcttccaagccctacaagggtattgttgactgcttcaacctcccttaagggtaaagggttctctccttgggggggggaacccgcaaaagttttccttaccccccaccggggtttaaatttttttttagggcaccttaaagggggttcaccccca

SEQ ID NO: 38859 - protein, 76 aa, Zea mays
  misc_feature: Ceres CLONE 1428069-F
  misc_feature (54)..(54): Xaa is any aa, unknown, or other
  misc_feature (61)..(61): Xaa is any aa, unknown, or other
MADQANQPTVLHKLGGQFHLRSIISEGVRARNICPSVSSYERRFATRNYMTQSXLGPFHVXVAWASCPSDADPALC

SEQ ID NO: 38860 - DNA, 650 bp, Zea mays
  misc_feature: Ceres CLONE 1428070-F
  misc_feature: Encodes the peptide sequence at SEQ ID NO. 38861
aaagctggagctccccgcggtggcggccgctctagaactagtggatcccccgggctgcaggaattcgcacgagaccattacctagaacatcctaatcgaaaaagaccttctttcggtcccgtcctttcccctgcgcgccgcgagtgaattccggagtccccaatctatccgacgccacacgaaacgaaacacaagagaagagagaagagaatagagagaaggtcgaagggctagacccggtcccccaattccaattcgcccctctcgcggccggcctcgcgagacgccgattcggatcccatctcctgctcagagcctcgattcgaccggcgggggcgacgattcgaccgggtcggtagccaggcagaggcagcggaaggagaggatgagcttccaggacctggaggcggggcacgtccgcggggcgccgctcggcggcggccggaggaacggcaggggccccgcgggggcggggggcgccggcgccggcgcgtcgcaagccgtggcgtcgggcgtcttccagatcaacaccgcggttgccacgttccagcgcctcgtcaacacgctcggcacgcccaaggataccccccgacctccgcgacaggatacataaaacacggcaacacataacacaactagtggaaggatac

SEQ ID NO: 38861 - protein, 75 aa, Zea mays
  misc_feature: Ceres CLONE 1428070-F
MSFQDLEAGHVRGAPLGGGRRNGRGPAGAGGAGAGASQAVASGVFQINTAVATFQRLVNTLGTPKDTPRPPRQDT

SEQ ID NO: 38862 - DNA, 663 bp, Zea mays
  misc_feature: Ceres CLONE 1428071-F
  misc_feature: Encodes the peptide sequence at SEQ ID NO. 38863
  misc_feature (255)..(255): n is a, c, t, g, unknown, or other
  misc_feature (380)..(380): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (643)..(643): n is a, c, t, g, unknown, or other
  misc_feature (645)..(645): n is a, c, t, g, unknown, or other
agctccccgcggtggcggccgctctagaactagtggatcccccgggctgcaggaattcgcacgagaccattacctagaacatcctaatcgaaaagagagtagtcatgtgcgagtgcgccccggcgcagtcctaacggtacgtaggtctctccacggtggtttagtgaagttaagaacaccgccatggtgacaggccaggtcaaggcggccatgggcttccagcgcagccccaagtcgcaggtgccggaggcggcntctccttctcggggcgctacgtcggggtccgtgtccaccgccggggtcgcgccgtccaaggcgtcggcgctcgcgcggtctttcggcgcgtacttcccgcgctcttcggcacaagtgcgccccgncggcccgcgcgtcgccgcaggtcgccgagctgctgccccccatcaagcactccaggaagcgggatccccccctccccgtggaacttcctgttacaaattatccttcaaggaaaccttccccattcctccccgtttcctgaaggccaaattccccgcccaaaaaagcccaaacctccccgggtctctttaaattttggaaaactttctttnnnnncttaaaaacaccccccccgggggggaggnnnnccccnnnnnaataaaantntaccccccccccccccta

SEQ ID NO: 38863 - protein, 128 aa, Zea mays
  misc_feature: Ceres CLONE 1428071-F
  misc_feature (66)..(66): Xaa is any aa, unknown, or other
MVTGQVKAAMGFQRSPKSQVPEAASPSRGATSGSVSTAGVAPSKASALARSFGAYFPRSSAQVRPXGPRVAAGRRAAAPHQALQEAGSPPPRGTSCYKLSFKETFPIPPRFLKAKFPAQKSPNLPGSL

SEQ ID NO: 38864 - DNA, 662 bp, Zea mays
  misc_feature: Ceres CLONE 1428072-F
  misc_feature: Encodes the peptide sequence at SEQ ID NO. 38865
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaaaaccttcgctgctgcttcgcaacggtgccgcggcttcggacagggctctcgcgacgcgatcggccatggcggcgtctctgcgggcctcgtcctccctccgctcgcgcctcctctcgttctcctcggggtgttctctgtgtccgtggcgtctcctcctctcctcacctgtccactcggacgccccccaccagaccgaaaccctcgctttcgacgagatccagctgtcgccggagaagccggctaccgccactgccttcgtcctgcacggcctcctcggttccggccgcacctggcgctccttctctcgcgccctcgtctccgaactccgtacccgctcccttcagacgagtgaaggatggtccccgggcacttgaggaaccctggcaaatccgggggggaacacaggggcccggccccccccccaaaatattttcctgcccccaaagaccccccttaatttaatgaaaaccccccgtgttggcccttgcccccgattttttttgcgcccccccccctgggggggaaaaacccccctcccaaattccccgagaaactcccn

SEQ ID NO: 38865 - protein, 102 aa, Zea mays
  misc_feature: Ceres CLONE 1428072-F
MAASLRASSSLRSRLLSFSSGCSLCPWRLLLSSPVHSDAPHQTETLAFDEIQLSPEKPATATAFVLHGLLGSGRTWRSFSRALVSELRTRSLQTSEGWSPGT

SEQ ID NO: 38866 - DNA, 696 bp, Zea mays
  misc_feature: Ceres CLONE 1428073-F
  misc_feature: Encodes the peptide sequence at SEQ ID NO. 38867
  misc_feature (444)..(444): n is a, c, t, g, unknown, or other
caaagctggagctccccgcggtggcggccgctctagaactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccgtccgcggcggcgtggtttattgacggcgcccgcgggacggttttttttttccntctcctttttcctcccgggtttcgtgctcgccgccctggggggggctgcttcctcctcctcctggcttcttgggcgcctctgcctctcccgccccggtgctggtttcggggctgttcggggcggggtcgtgccctggttctggtgtcggctccctcgcgggtcctggccccgcccctgttctcgctggtgcgttgcctgtcctccccgttcggtggtgtgcctctgtgtcctcctttggtttccctcgtcct

SEQ ID NO: 38867 - protein, 60 aa, Zea mays
  misc_feature: Ceres CLONE 1428073-F
MDSLPRKRKGARAACSLAGSRHDAPAARKRTCREPKPRPEKKKPSSADEGSASVRGGVVY

SEQ ID NO: 38868 - DNA, 690 bp, Zea mays
  misc_feature: Ceres CLONE 1428077-F
  misc_feature: Encodes the peptide sequence at SEQ ID NO. 38869
  misc_feature (584)..(584): n is a, c, t, g, unknown, or other
  misc_feature (629)..(629): n is a, c, t, g, unknown, or other
  misc_feature (681)..(681): n is a, c, t, g, unknown, or other
  misc_feature (690)..(690): n is a, c, t, g, unknown, or other
aaagctggagctccccgcggtggcggccgctctagaactagtggatcccccgggctgcaggaattcgcacgagaccattacctagaacatcctaatcgaaaaatgtagctctttctggtcccaggagaacgagccgctcgctgatgtgggagcttgtcagcaccgtggatcgcccaaacggccagacgtgatgtctcgcccacgtgtcccttgcccctgtccacctgtcccctccggagcctgcaaagaactcccctccccgctatcatttccggcgcagaaaaggagagtaacactcaacactgcagaaatcagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaagctccgtctacggcctctggaagctgtacaaggacacggcaacgccgggcggcctgctcgcggtggccatcgcgcacacgctggcgctggtggccgcngtggcggtagcaagcaacgcgtcgggtgggcacgtcaaccctgcngtcacgttcgggctgctcgtgggccgccgcatcttcttcgggcgtgcggcgntatactggn

SEQ ID NO: 38869 - protein, 110 aa, Zea mays
  misc_feature: Ceres CLONE 1428077-F
  misc_feature (108)..(108): Xaa is any aa, unknown, or other
MLPGRHPARRADATGTGPLLPDATRAVVAEFVATAMFVFAAESSVYGLWKLYKDTATPGGLLAVAIAHTLALVAAVAVASNASGGHVNPAVTFGLLVGRRIFFGRAAXYW

SEQ ID NO: 38870 - DNA, 774 bp, Zea mays
  misc_feature: Ceres CLONE 1428082-F
  misc_feature: Encodes the peptide sequence at SEQ ID NO. 38871
  misc_feature (399)..(399): n is a, c, t, g, unknown, or other
  misc_feature (400)..(400): n is a, c, t, g, unknown, or other
  misc_feature (425)..(425): n is a, c, t, g, unknown, or other
  misc_feature (429)..(429): n is a, c, t, g, unknown, or other
  misc_feature (436)..(436): n is a, c, t, g, unknown, or other
aaagctggagctccccgcggtggcggccgctctagaactagtggatcccccgggctgcaggaattcgcacgagaccattacctagaacatcctaatcgaaaagtgttttcgcttccccttccccatcccctctcctcccctcgccggcttgtcggtctcgccgcgccactggccatacatccaagacgctaatccgtgtgggggaaaagcccccctctctctgaaactattcaaatggcgtggggcgtatccccgcggcggcagccgtcgttcccggtgcaggccctctacgagctctgcaagcgctccttcccctccccttccgccgcctcatcgtctcccccgcccgctgatgtcgtccgcagcatctcctcgctcatggatacaatcactcctgcnngatgtgggctcagagattataatcntgangacgacngggggcatgaatttttttgactccaacctccctcaaggtccaggaaggcttccttcgggggggccgggcccatcaggaccttcataactacaggtgggggggcattctctattggaaatttccgggttgcccaatttcaaaaaaatttcccccttcggggaaccccggaaaaggactgttccgggaaaaaatctttttgggtcccccggggggggaaaaactattgtttgggaaaacccctcccttccctccaaaaaaaccccccccccaagggggggggcgaaaaaaataaaaaaaaaaaagatatcccgagtgccctttaaacccaacactttttt

SEQ ID NO: 38871 - protein, 73 aa, Zea mays
  misc_feature: Ceres CLONE 1428082-F
  misc_feature (56)..(56): Xaa is any aa, unknown, or other
  misc_feature (64)..(64): Xaa is any aa, unknown, or other
  misc_feature (65)..(65): Xaa is any aa, unknown, or other
  misc_feature (68)..(68): Xaa is any aa, unknown, or other
MAWGVSPRRQPSFPVQALYELCKRSFPSPSAASSSPPPADVVRSISSLMDTITPAXCGLRDYNXXDDXGHEFF

SEQ ID NO: 38872 - DNA, 667 bp, Zea mays
  misc_feature: Ceres CLONE 1428093-F
  misc_feature: Encodes the peptide sequence at SEQ ID NO. 38873
aagctggagctccccgcggtggcggccgctctagaactagtggatcccccgggctgcaggaattcgcacgagaccattacctagaacatcctaatcgaaaaccacagcctccccagcatcagtgaagctcgctcaccgtcattcgacgacgccctcccgcacacacgaccatggccgcggcgatgaccggcagtgctcgcgccagcaccggctccttgctcgtgcttctcttcgtcgcgctggccggcgcgaccgccggggcgagtgccaccgttgccttcagcagcggcgacagcaacgcggcggcgctgctgacgacgccagcatcggcgtccccggggcagctgaacggcatcatccagtgccttatgggctgcttcacgcaggtgttcggctgttcgttcggatgcatgggcaagcagggcgctgaacttgccgctctgcatcatcagctgccaccagagagcgtcgtgtgcattggcagctgcgggcttgcgccgtcaccgccatcaccgtcgccgcccacgcccaaaccaccaggcacccaagccgcccacgccaaagccggccgggccggccctaaacccccgccgttaaggccccccctttgcgttcccccggagagcaaattttgccctgaaaatttgccaaaccgtggccccgcccc

SEQ ID NO: 38873 - protein, 165 aa, Zea mays
  misc_feature: Ceres CLONE 1428093-F
MAAAMTGSARASTGSLLVLLFVALAGATAGASATVAFSSGDSNAAALLTTPASASPGQLNGIIQCLMGCFTQVFGCSFGCMGKQGAELAALHHQLPPESVVCIGSCGLAPSPPSPSPPTPKPPGTQAAHAKAGRAGPKPPPLRPPLCVPPESKFCPENLPNRGPA

SEQ ID NO: 38874 - DNA, 676 bp, Zea mays
  misc_feature: Ceres CLONE 1428098-F
  misc_feature: Translation starting site: 487
  misc_feature: SWISSPROT Homolog: EC 3.1.3.16 Phosphoprotein phosphatase
  misc_feature (297)..(297): n is a, c, t, g, unknown, or other
  misc_feature (298)..(298): n is a, c, t, g, unknown, or other
  misc_feature (314)..(314): n is a, c, t, g, unknown, or other
  misc_feature (315)..(315): n is a, c, t, g, unknown, or other
  misc_feature (320)..(320): n is a, c, t, g, unknown, or other
  misc_feature (327)..(327): n is a, c, t, g, unknown, or other
aagctggagctccccgcggtggcggccgctctagaactagtggatcccccgggctgcaggaattcgcacgagaccattacctagaacatcctaatcgaaaactacaagctctttggaggagtagagacttccagccatcccttctacgctctccccgttcccgtgtcgtcctcccgacaaagagggagccgctagggtttagcggcttccgcttctgggcgagggcttacccgcgagggacggcgcgacgcggcggcacttgagctagggtttccctccgatcccgttccttttccnngcgagcgatggacganngcgcnattgacnacttgatcccggcggctcctcgaggcccgcggcgggcgcaccccgcgcaacgcgcaggtgactgacgccaagatccggcgcctctgcgccaccgcaaggacgtttttctctcccagcccaacctcctggagctcgaggcccccattaagatatgcggggatgtccatggccaatattcaaaactccctcgattatttgagtatgggggctattcaccagatgccaattttctggttcctgggtgacttatgtgatccggggaaaacaaaacttagaaacaatttgccttctcttggcgtacaaaataagtccctagaaaacttctttctctcagggaaaaccttgaagg

SEQ ID NO: 38875 - DNA, 632 bp, Zea mays
  misc_feature: Ceres CLONE 1428099-F
  misc_feature: Encodes the peptide sequence at SEQ ID NO. 38876
  misc_feature (611)..(611): n is a, c, t, g, unknown, or other
ggagctccccgcggtggcggccgctctagaactagtggatcccccgggctgcaggaattcgcacgagaccattacctagaacatcctaatcgaaaaagtagtaaaaccaggtaggtgtggctggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcangaagcagataggcgctgtggc

SEQ ID NO: 38876 - protein, 160 aa, Zea mays
  misc_feature: Ceres CLONE 1428099-F
  misc_feature (15)..(159): Pfam Name: Ras Pfam Description: Ras family
  misc_feature (15)..(128): Pfam Name: Miro Pfam Description: Miro-like protein
  misc_feature (154)..(154): Xaa is any aa, unknown, or other
MSAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELXKQIGAV

SEQ ID NO: 38877 - DNA, 672 bp, Zea mays
  misc_feature: Ceres CLONE 1428100-F
  misc_feature: Translation starting site: 343
  misc_feature (311)..(311): n is a, c, t, g, unknown, or other
  misc_feature (415)..(415): n is a, c, t, g, unknown, or other
  misc_feature (447)..(447): n is a, c, t, g, unknown, or other
  misc_feature (523)..(523): n is a, c, t, g, unknown, or other
  misc_feature (528)..(528): n is a, c, t, g, unknown, or other
  misc_feature (529)..(529): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggngggctagctagctgagctcgtgcgacgaagaatggccggaattggcaggaacatggtggcgccgctcctggtgctcaacctcatcatgtacatcatcgtcatcngcttcgcgagctggaacctgaaccacttcatncacgggcagaccaactaccccggcgtggccggcaacggcgcgacgttctacttcctggtgttcgccatcctgcccngcgtnngtgggcgcgctccaaactagcgggcgtgcaccacgtgcgcgcctggcgccacgacagcctggccaccaacgccgcgtcgtcgctcatcgcctgggccatcacggcgctcgccttcgggctggcctgcaaggaaaccacatcgn

SEQ ID NO: 38878 - DNA, 638 bp, Zea mays
  misc_feature: Ceres CLONE 1428101-F
  misc_feature: Encodes the peptide sequence at SEQ ID NO. 38879
  misc_feature (284)..(284): n is a, c, t, g, unknown, or other
  misc_feature (287)..(287): n is a, c, t, g, unknown, or other
  misc_feature (296)..(296): n is a, c, t, g, unknown, or other
  misc_feature (312)..(312): n is a, c, t, g, unknown, or other
  misc_feature (317)..(317): n is a, c, t, g, unknown, or other
  misc_feature (370)..(370): n is a, c, t, g, unknown, or other
  misc_feature (374)..(374): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatgggtggcgttcctcctgctcgccggcgtgctgctggtcgtancancccacgccnggggcgaagaacgaantgtcnaacgggacccgcagggagacctgcggtggtgcaagcaggcctgcaagtggcantacngaaaggaccccccccggaaaagggaatgccaaaacaaattcccccaagcggaacccaaaaaacttaaccccggcaaaggacgggcaaacggggggttggaaccccttagttttccccttcccggaaggggcgaagtttcccccccccattttcttggcccccccccacaggggcccaccccggggggaaacccccccatatttttttttgggggggggggcccccccccccccccggaaagggggggccccaaaaaaaagaaaa

SEQ ID NO: 38879 - protein, 141 aa, Zea mays
  misc_feature: Ceres CLONE 1428101-F
  misc_feature (24)..(24): Xaa is any aa, unknown, or other
  misc_feature (25)..(25): Xaa is any aa, unknown, or other
  misc_feature (28)..(28): Xaa is any aa, unknown, or other
  misc_feature (33)..(33): Xaa is any aa, unknown, or other
  misc_feature (35)..(35): Xaa is any aa, unknown, or other
  misc_feature (52)..(52): Xaa is any aa, unknown, or other
  misc_feature (54)..(54): Xaa is any aa, unknown, or other
MGKGSVGASWVAFLLLAGVLLVVXXHAXGEERXVXRDPQGDLRWCKQACKWXYXKDPPRKRECQNKFPQAEPKKLNPGKGRANGGLEPLSFPLPGRGEVSPPHFLGPPPQGPTPGGNPPIFFFGGGGPPPPPERGGPKKKK

SEQ ID NO: 38880 - DNA, 684 bp, Zea mays
  misc_feature: Ceres CLONE 1428109-F
  misc_feature: Encodes the peptide sequence at SEQ ID NO. 38881
  misc_feature (301)..(301): n is a, c, t, g, unknown, or other
  misc_feature (346)..(346): n is a, c, t, g, unknown, or other
  misc_feature (529)..(529): n is a, c, t, g, unknown, or other
  misc_feature (578)..(578): n is a, c, t, g, unknown, or other
  misc_feature (640)..(640): n is a, c, t, g, unknown, or other
ggagctccccgcggtggcggccgctctagaactagtggatcccccgggctgcaggaattcgcacgagaccattacctagaacatcctaatcgaaaaaatgtcaaaagaacccgcagcaggggagactgggagatagagagaggagagggagggtttcctcaaagagaacccgaaacaaacccaagcagagaacactagcgttccctcaccagggcgtccatcccagcagccatggcgatggcgtacaagatggtaaaaactcccccgcgctccggccatgcgccggcgccgcagccgcttngcatcgagcagccatggctcacgatcgacgctctgtgtgtctgcntgcgtggtttgcaggcaacggaggggatgaacgtgaaggaggagtgccagcgctggttcatggagatgaagtggaagaaggtgcaccgcttcgtggtgtacagatcgacgagcggtccccccccttgctggtggacaaaggtggcggcccccgggaaagggtacgaggagctcgtggcccccnctgcccggaaaaaactgccccctaccccctctttcaacttcaaacttcnccaccggtcaacaactgccaagagaagcaaagatctttcttccatcgcctgggccaccgggngggtgtcaaaagaatcaggggccaaaaaatcctgttaccccaaa

SEQ ID NO: 38881 - protein, 151 aa, Zea mays
  misc_feature: Ceres CLONE 1428109-F
  misc_feature (24)..(24): Xaa is any aa, unknown, or other
  misc_feature (39)..(39): Xaa is any aa, unknown, or other
  misc_feature (100)..(100): Xaa is any aa, unknown, or other
  misc_feature (116)..(116): Xaa is any aa, unknown, or other
  misc_feature (137)..(137): Xaa is any aa, unknown, or other
MAMAYKMVKTPPRSGHAPAPQPLXIEQPWLTIDALCVCXRGLQATEGMNVKEECQRWFMEMKWKKVHRFVVYRSTSGPPPCWWTKVAAPGKGYEELVAPXARKKLPPTPSFNFKLXHRSTTAKRSKDLSSIAWATGXVSKESGAKKSCYPK

SEQ ID NO: 38882 - DNA, 911 bp, Zea mays
  misc_feature: Ceres CLONE 1428112-F
  misc_feature: Encodes the peptide sequence at SEQ ID NO. 38883
  misc_feature (11)..(11): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (495)..(495): n is a, c, t, g, unknown, or other
  misc_feature (657)..(657): n is a, c, t, g, unknown, or other
  misc_feature (807)..(807): n is a, c, t, g, unknown, or other
ggttggtgggngtnggggnngggnncnttttaagcanaaggnnnagggnnnnnaaaaacggggctccccgcggtggcggccgctctagaatagtggatcccccgggctgcaggaattcgcacgagaccattacctataaatcctaatcgaaaaactccgatcctgccctctaataacagcagcagcagccgccatggaaggcagcaccaagaagctccagccgttccctcctcacgctgctgctggtgctctccgccgccgggacgcccatcggctcgctggggatgccagaggaagagtgatcgtgtgagtgggacaaagggaggggggccgagctgtgcggcgcccggcgggtatcgggctccccccatccgggagccagaaagctagggatcccccaagcgcacccaaacggcaccccacccgggaggaggggagggggaggggccccccggccccccccgggggcggggggggggagaagcgggcaccacnccccggggggggggggggccgcgcggctgcggccgcgggcccgcgggcgggggggggggggcggcgcggcggcgccgcgcgtcgggcgggcacgcgcccgcgccggggcgggggcgccggccggcggccgggcgcgcgggcgcggcgcgccccgggcgggtncaccgcgggcaggcgggccggcgggaggaggcggaaggggcgacgcgccggcacgcgggcaccgcgcgaggcgggggggtgggcccgccgcgccgcccgggcggccgcgcgtcggccggccggcgccggggcggggcggcggcggggccncgccgctcgccggccggcgcgcgcgggcctcgggccgcggcggcccccgctcgcgccccgacgcgccgcggggggcgcgcgcgcgcgtcggcgggggcggcggg

SEQ ID NO: 38883 - protein, 38 aa, Zea mays
  misc_feature: Ceres CLONE 1428112-F
MEGSTKKLQPFPPHAAAGALRRRDAHRLAGDARGRVIV

SEQ ID NO: 38884 - DNA, 709 bp, Zea mays
  misc_feature: Ceres CLONE 1428113-F
  misc_feature: Encodes the peptide sequence at SEQ ID NO. 38885
  misc_feature (408)..(408): n is a, c, t, g, unknown, or other
  misc_feature (424)..(424): n is a, c, t, g, unknown, or other
aagctggagctccccgcggtggcggccgctctagaactagtggatcccccgggctgcaggaattcgcacgagaccattacctagaacatcctaatcgaaaaaagacgcgcgcgcagaagcacacctgctcgggctagattaggaggacagcttcttcggccggcgacatggcggaggagaagggcgcgttgcagtcggcgagggagtgggtggtcgaccacaagctccgggccgtcgggacgctgtggctcagcggcatcgtcggctccatcgcctacaactggtccaggccgggcatgaagaccagcgtcaagatcatccacgccaggctgcatgctcaggctctcacgctggctgcctgggctgggtccgcgctggtggagtactacgaccacccagcagggtcanggatcgaagtccaccnatatgcaaagcaggttcctttcatctgataggcatagccgcccaaccaaaggagtagctagctaggggtctttgcaaggtgcaaacccgggagggggctttattttctgaaccaattattttggccaaggggccatttcgggggaaattttgacgagattttggcccgggtttttcttgggaagggaagcctgttaaaacccgccccccccaaaatttttggtatcccaaagggcccccctccttttttttcaaaaaaaaaaaaaaaaatcttttccctcccccc

SEQ ID NO: 38885 - protein, 94 aa, Zea mays
  misc_feature: Ceres CLONE 1428113-F
  misc_feature (81)..(81): Xaa is any aa, unknown, or other
  misc_feature (86)..(86): Xaa is any aa, unknown, or other
MAEEKGALQSAREWVVDHKLRAVGTLWLSGIVGSIAYNWSRPGMKTSVKIIHARLHAQALTLAAWAGSALVEYYDHPAGSXIEVHXYAKQVPFI

SEQ ID NO: 38886 - DNA, 675 bp, Zea mays
  misc_feature: Ceres CLONE 1428116-F
  misc_feature: Encodes the peptide sequence at SEQ ID NO. 38887
  misc_feature (580)..(580): n is a, c, t, g, unknown, or other
  misc_feature (593)..(593): n is a, c, t, g, unknown, or other
aagctggagctccccgcggtggcggccgctctagaactagtggatcccccgggctgcaggaattcgcacgagaccattacctagaacatcctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggctgcactccccgccgacgccttcgccaccgcgctggtcatcttcctcggcgactacaacgatcgcggcccgcacacccgcagggtcctcgacttcctcctcgcgctcccgacgcgctaccccgcgcagcgccacgtcttcctctgcggcaaccacgacctcgccttcgcggcgttcgtcggggcgctgccgccgccgcccgacggctccccgttctcggccacctgggacgagtacatcccacacgaggagcacgagggggtggttccgcggggcggggattcgagggcatgcacntgcaggggaagcngtggggcggggtcatccagggagagtggaaccccaagaaggggctcccgtacaggggctccatctacgacgcgcaggccacc

SEQ ID NO: 38887 - protein, 162 aa, Zea mays
  misc_feature: Ceres CLONE 1428116-F
  misc_feature: SWISSPROT Homolog: EC 3.1.3.16 Phosphoprotein phosphatase
  misc_feature (136)..(136): Xaa is any aa, unknown, or other
MSAPSAPPRTVICVGDVHGYITKLESLWSNLQAALPADAFATALVIFLGDYNDRGPHTRRVLDFLLALPTRYPAQRHVFLCGNHDLAFAAFVGALPPPPDGSPFSATWDEYIPHEEHEGVVPRGGDSRACTCRGSXGAGSSRESGTPRRGSRTGAPSTTRRP

SEQ ID NO: 38888 - DNA, 670 bp, Zea mays
  misc_feature: Ceres CLONE 1428121-F
  misc_feature: Encodes the peptide sequence at SEQ ID NO. 38889
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtgcacctctcggggagggggggcgaggacctagtcgagcaggtgacgcacccgggccgggacggtgggcttcttctggctggtgaaccacggagtgccggaagagctgattggccgcatgctcccccggggtccgccagttccacgagggccccgtggaagccaagccagccctctactcgagggacctccctcccaacctgggcttcccctccaatttcgacttctttcaggctggctgcggccaaattggcccaaccctctctttttggagggggctccaaacccccccccgcgggan

SEQ ID NO: 38889 - protein, 174 aa, Zea mays
  misc_feature: Ceres CLONE 1428121-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVHLSGRGGEDLVEQVTHPGRDGGLLLAGEPRSAGRADWPHAPPGSASSTRAPWKPSQPSTRGTSLPTWASPPISTSFRLAAAKLAQPSLFGGGSKPPPAG

SEQ ID NO: 38890 - DNA, 663 bp, Zea mays
  misc_feature: Ceres CLONE 1428126-F
  misc_feature (457)..(457): n is a, c, t, g, unknown, or other
  misc_feature (462)..(462): n is a, c, t, g, unknown, or other
  misc_feature (473)..(473): n is a, c, t, g, unknown, or other
  misc_feature (528)..(528): n is a, c, t, g, unknown, or other
  misc_feature (567)..(567): n is a, c, t, g, unknown, or other
ggagctccccgcggtggcggccgctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttccgtccgtgcccctcccgtcctgnatctngtgcgcgagangcgcgcagcgcgcgagattgcgcccccttctcttctcctaggaagcaggaagcangccgaccgctcgctgagcgccgccgccgaatggcgtcgncgttgccaatgaagctctgggagggtggagacccgcgggcagggccgccgccgcggggcccgacgaccccctgcggggtcctggggacggggaccg

SEQ ID NO: 38891 - DNA, 718 bp, Zea mays
  misc_feature: Ceres CLONE 1428133-F
  misc_feature: Encodes the peptide sequence at SEQ ID NO. 38892
  misc_feature (419)..(419): n is a, c, t, g, unknown, or other
  misc_feature (547)..(547): n is a, c, t, g, unknown, or other
  misc_feature (676)..(676): n is a, c, t, g, unknown, or other
  misc_feature (677)..(677): n is a, c, t, g, unknown, or other
ctccccgcggtggcggccgctctagaactagtggatcccccgggctgcaggaattcgcacgagaccattacctagaacatcctaatcgaaaaattcttccttccttctttccttcaccaatggccacgagaatagccttgtgtcttctcggccacgtcctcctcgccgtcgcgtcgatggcagtggcggcggcggccggtgacgcgggcaagatcggcatctgccacggccgcgttggcagtaacctcccgccgccgtcggccgccgcggcactgctcaagcggaacgggatcaccaaggcgcggctcttcctgccggacccggccgtgctcccggccttcgccgcggcgggcatcgacctcatggtgggcgtgcccaacgaaaacctcaccttcctggccgcggcggggcccgagggncgcgcgcagtggctgcggtccgcggtcctggcccacgcccccgccgagcgcgtccggtgccctcgcgtcggcaacgaggtgctgtacaacaaccagttctatgcgcctcacctcgtgcccggcatgcngaacctgcacgccgcgctcgccaccctggggctggacggcagggtcaagggtctctccgcgcacgcctcctcggtgctggccggctcgtacccgccctccgccggcgggtcgacgccgcctccttcccnngtctcgcccatgctgcggttctggccgacccggtgcgcctt

SEQ ID NO: 38892 - protein, 199 aa, Zea mays
  misc_feature: Ceres CLONE 1428133-F
  misc_feature (32)..(199): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature (143)..(143): Xaa is any aa, unknown, or other
  misc_feature (186)..(186): Xaa is any aa, unknown, or other
MATRIALCLLGHVLLAVASMAVAAAAGDAGKIGICHGRVGSNLPPPSAAAALLKRNGITKARLFLPDPAVLPAFAAAGIDLMVGVPNENLTFLAAAGPEGRAQWLRSAVLAHAPAERVRCPRVGNEVLYNNQFYAPHLVPGMXNLHAALATLGLDGRVKGLSAHASSVLAGSYPPSAGGSTPPPSXVSPMLRFWPTRCA

SEQ ID NO: 38893 - DNA, 638 bp, Zea mays
  misc_feature: Ceres CLONE 1428136-F
  misc_feature: Encodes the peptide sequence at SEQ ID NO. 38894
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcactaccgaaaggaacaccgcgcgaagaaggaatgccagagcgagtgccccgagccgcaccagcaagctgacgcgggcgaagacggcgacagcggcgtggacgcctacgtctcccgctccgggaggggcgagtgccggccccagtgcctgcgcccgcacgaggggcaggcgtgggagaaccaggaatgcatgaggcggtgccgccgccgcggactggccgtcaaatggagcaagagtacggtcgcggcaccaagagcccgggcaatgcccgg

SEQ ID NO: 38894 - protein, 141 aa, Zea mays
  misc_feature: Ceres CLONE 1428136-F
MGKGSVGASWWAFLLLAGVLLVVAATAGAEDGVVERDRKEDLRWCKQACEWHYRKEHRAKKECQSECPEPHQQADAGEDGDSGVDAYVSRSGRGECRPQCLRPHEGQAWENQECMRRCRRRGLAVKWSKSTVAAPRARAMP

SEQ ID NO: 38895 - DNA, 658 bp, Zea mays
  misc_feature: Ceres CLONE 1428139-F
  misc_feature: Encodes the peptide sequence at SEQ ID NO. 38896
ctccccgcggtggcggccgctctagaactagtggatcccccgggctgcaggaattcgcacgagaccattacctagaacatcctaatcgaaaactgttaattccatttcctctcttttgacgacggatacgaggcacgatcacacgctgaaggcttgcgccccgccggcaccttcaccgctctcctccctccgatcgcctccgcttccgttccgcgccctgcccccggaagggaagcgaagccctcgctacttgcggagcgtctgtggtcaaaccctagcacacgtacgagcaggccagccccgcccgctcccattcccaggccctcatccatggcggcgctctccgtgcccctccacgtctccgccggatcccgcgccgcctcggcctaccccatcaagggtccgtgcgtgaggagcactggatcatcccatttcagccgcgccttcccctacgtcgcggtctcctctttggctgcgacgcacatccagccgatgagagcggatatctacaccggcacccccctgccgtgccacaatatttggaggggggagaagaccaaagatcggtatcagcggggtttgggcctgaattgacagggtcggcccctggccaaatggcaaccgtgccagaagaccgatcatttgaaagtttgtggcg

SEQ ID NO: 38896 - protein, 87 aa, Zea mays
  misc_feature: Ceres CLONE 1428139-F
MAALSVPLHVSAGSRAASAYPIKGPCVRSTGSSHFSRAFPYVAVSSLAATHIQPMRADIYTGTPLPCHNIWRGEKTKDRYQRGLGLN

SEQ ID NO: 38897 - DNA, 660 bp, Zea mays
  misc_feature: Ceres CLONE 1428141-F
  misc_feature: Translation starting site: 197
  misc_feature (285)..(285): n is a, c, t, g, unknown, or other
  misc_feature (433)..(433): n is a, c, t, g, unknown, or other
  misc_feature (452)..(452): n is a, c, t, g, unknown, or other
aagctggagctccccgcggtggcggccgctctagaactagtggatcccccgggctgcaggaattcgcacgagaccattacctagaacatcctaatcgaaaagttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccangccatcttctggaccctcacagtccagggagtgccttcctctgatcctcatcatcaggaacagggctcagtatgctctgaactaccgtgaggtcatttctatcctgatgcaacgccatgtacttgttgatggcaaggtcaggactgancagacctaccctgctgggntcatggatgtcatttccatcccccagacatggagaactacaggctgctttatgacacaagggccgcttccgtcttcacccaatcagggatgaggatgccaagtttcagctctgcagggtgaggtctgttcagttttgccagaagggcatcccctacctgaacacctacgacggccgcaccatccgctaccccgacccgctcatcaagg

SEQ ID NO: 38898 - DNA, 687 bp, Zea mays
  misc_feature: Ceres CLONE 1428143-F
  misc_feature: Encodes the peptide sequence at SEQ ID NO. 38899
  misc_feature (404)..(404): n is a, c, t, g, unknown, or other
  misc_feature (405)..(405): n is a, c, t, g, unknown, or other
  misc_feature (434)..(434): n is a, c, t, g, unknown, or other
caaagctggagctccccgcggtggcggccgctctagaactagtggatcccccgggctgcaggaattcgcacgagaccattacctagaacatcctaatcgaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccgatcccaggccttcgttgacccttcgccgtaacgagatcagatggctgggatatgtcaagagggccccaaaatggttctgtgtatgtctgcaatctacctcctggaactgatgaaaatatgttggctgaatattttggcacatagtgtttataaaagggatatggnntctaaccaaaaagaaaaaaaggactgggncctcccaaaatttgaaattttccgggacaaagttactaattgaaccaaagggtgatgccaccgtcaccttaggaggaacccacttgttgttttaccttgcttggaaaagggtccaaaaaccagggatttcccgggggaccccttttcgggtttccaatggcttggactcaaaagcaaagaatggtttttttaaacccccccacagtttgaaacatctttggggggtgtggggaaaacaaaaaaaaacttggta

SEQ ID NO: 38899 - protein, 30 aa, Zea mays
  misc_feature: Ceres CLONE 1428143-F
MSRGPQNGSVYVCNLPPGTDENMLAEYFGT

SEQ ID NO: 38900 - DNA, 746 bp, Zea mays
  misc_feature: Ceres CLONE 1428147-F
  misc_feature: SWISSPROT Homolog: EC 2.7.11.24 Mitogen-activated protein kinase
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (45)..(45): n is a, c, t, g, unknown, or other
  misc_feature (47)..(47): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
nttttnnnnccccccccnnnccctcccccccccctcccccccccngnggtctnnnnnnntcagactggagctccccgcggtggcggccgctctagaactagtggatcccccgggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcgcccccccggcccctactcccgaggtcattggcgtgtgctccttggcagaaaatggcgatgatggtggatcccccccatggcatggcaagtcaaggaaagcattactatactatgcgggcacacactggtttgagatcgacccccagttacgtgccccattcaagcccatccggaacggggagctttacgggaatcgctttgctcaatcttgttaaaccgccgaggatccaatggaaaaaaggtccgcgaataagagaaaggattaaaacccaccgtcctttttgaacccaacccgcaggtgaggaaatgcgcgcttacagggacccgcctgcaaagaggag

SEQ ID NO: 38901 - DNA, 742 bp, Zea mays
  misc_feature: Ceres CLONE 1428148-F
  misc_feature: Encodes the peptide sequence at SEQ ID NO. 38902
aaagctggagctccccgcggtggcggccgctctagaactagtggatcccccgggctgcaggaattcgcacgagaccatacctagaacatcctaatcgaaaaaactactccgtcactttgtttacaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcacggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgaccccccccgtggtggggctggccgtggccacgccggtgttcctgatcttcagccccgtgctcgtccccgccgcgctgctcatcgggacggccgtcatggggttcctcacgtcgggcgcgctggggctcgggggcctgtcctcgctcacgtgcctcgccaacaccggcgcggcaggcgttccagcccaccccggactaattgggaggaggcccaccctaaagatggccgaaggccggggccccacagcggacccaaaagacccgcgacaggaagggccaaggccattccaagggcgcagggctctaaagaggaccgggcgcccgggaggaa

SEQ ID NO: 38902 - protein, 179 aa, Zea mays
  misc_feature: Ceres CLONE 1428148-F
  misc_feature (44)..(158): Pfam Name: Oleosin Pfam Description: Oleosin
MADRDRSGIYGGAHATYGQQQQHGGGGRPMGEQVKGMLHDKGPTASQALTVVTLFPLGGLLLVLSGLALTPPVVGLAVATPVFLIFSPVLVPAALLIGTAVMGFLTSGALGLGGLSSLTCLANTGAAGVPAHPGLIGRRPTLKMAEGRGPTADPKDPRQEGPRPFQGRRALKRTGRPGG

SEQ ID NO: 38903 - DNA, 683 bp, Zea mays
  misc_feature: Ceres CLONE 1428149-F
  misc_feature: Translation starting site: 151
  misc_feature (366)..(366): n is a, c, t, g, unknown, or other
aaagctggagctccccgcggtggcggccgctctagaactagtggatcccccgggctgcaggaattcgcacgagaccattacctagaacatcctaatcgaaaaaacactttgagtcttgaagaaaggtcatcatcatcaacgtcgagaataatggcttctctttgtgcttcctctgccatcgccgccatttcttctcctagtttcttgtgtggcaagaagctaaggctgaacaagaagctgagtgttgcagctgtttccaatcagctgcgtctgtgcgggccgttgcagcggatcccgagagaccaatctggttccctggaagcactcctccagagtggctcgacggtagcctccctggtgacttcngatttgatcctcttggtctttcatctgaccccgatagtctaaaatggaacgtacaagcagagatagttcactgccggtggggcaatgctaggtggcgcccgaatttttatcccggagtttctaaccaagatcggggatctcaacacgccttcttggtacacttgcggaagagcaagagtatttcacggacaaaaccaccctcttggtcattgagctcatctaatagggatgggccgagggacttatatggccctatttcattaaaccccggtagcgtccacactgaaccatttttcccaaacacaaactgacgggag

SEQ ID NO: 38904 - DNA, 656 bp, Zea mays
  misc_feature: Ceres CLONE 1428157-F
  misc_feature: Encodes the peptide sequence at SEQ ID NO. 38905
  misc_feature (309)..(309): n is a, c, t, g, unknown, or other
  misc_feature (330)..(330): n is a, c, t, g, unknown, or other
  misc_feature (460)..(460): n is a, c, t, g, unknown, or other
aaagctggagctccccgcggtggcggccgctctagaactagtggatcccccgggctgcaggaattcgcacgagaccattacctagaacatcctaatcgaaaaccccccccatctctcctcccctccccatctcgctcttgcggagatcgaagagaagctgaggcctagcgccgcacccgccgccgcatcagccatcagccatggcgatggccgctcgcctcgtctcgcgctcccgtcagctacattcggttcaagcagcttttgcgaatggagggccactcaagttcgctcctttgccaagatgcagcntcagctgaccgtcctcctgtnggtggggatgatctcctgaagggcatattctttgaggtaaagaaaagtttgagacagctctcggcctccttaaaaaggaaagatcactattgatccagatgacccagcggcagtttctcaatatgctcanttcatgaaaactggaaggggaaaaggcggatctttctttctgattcccaagggataattttccctttgggaccctccccaagggctccccgaagccgggacctcctttaaaccccttccaaccgcccaaaaaaaaggggggcctttaagatccttttgggaaccccaccctctgggagaggggacccccctaaaaa

SEQ ID NO: 38905 - protein, 38 aa, Zea mays
  misc_feature: Ceres CLONE 1428157-F
  misc_feature (37)..(37): Xaa is any aa, unknown, or other
MAMAARLVSRSRQLHSVQAAFANGGPLKFAPLPRCSXS

SEQ ID NO: 38906 - DNA, 650 bp, Zea mays
  misc_feature: Ceres CLONE 1428161-F
  misc_feature: Encodes the peptide sequence at SEQ ID NO. 38907
  misc_feature (363)..(363): n is a, c, t, g, unknown, or other
  misc_feature (371)..(371): n is a, c, t, g, unknown, or other
  misc_feature (375)..(375): n is a, c, t, g, unknown, or other
ggagctccccgcggtggcggccgctctagaactagtggatcccccgggctgcaggaattcgcacgagaccattacctagaacatcctaatcgaaaatatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttcaccctacaggatccaacaggcaatcgcagctggcatcttacctttatcnaccttgtncctncgacaatcatcagccctattacaacagttacctttggtgcatttattggcacaaaacatcagggcacaacaactacaacaacttggtgctagcaaaaccttggctgcctacttctcaacaacagcagtttccttccttccacccaacttaggttcatggaacctctgcctctttatttgcaaaaaaaaacaacttaccatttagcccgggtacctgcttgcctaccccccaaaaatttttcttccttttcaacccaattgggcaacttttgactc

SEQ ID NO: 38907 - protein, 123 aa, Zea mays
  misc_feature: Ceres CLONE 1428161-F
  misc_feature (70)..(70): Xaa is any aa, unknown, or other
  misc_feature (73)..(73): Xaa is any aa, unknown, or other
  misc_feature (74)..(74): Xaa is any aa, unknown, or other
MAAKIFCLLMLLGLSASAATATIFPQCSQAPIASLLPPYLSSAVSSVCENPILHPTGSNRQSQLASYLYXPCXXDNHQPYYNSYLWCIYWHKTSGHNNYNNLVLAKPWLPTSQQQQFPSFHPT

SEQ ID NO: 38908 - DNA, 715 bp, Zea mays
  misc_feature: Ceres CLONE 1428163-F
  misc_feature: Encodes the peptide sequence at SEQ ID NO. 38909
ctccccgcggtggcggccgctctagaactagtggatcccccgggctgcatgaattcgcacgagacctttacctacaacatcctaaacaaaaaacatcgacaaaaacatctcctcaccctcgaagaggacaaaccaccaacaatcaccagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccccgggaaggacgagtgaataatcatgagctcgatctgccctttcgcgggagccaccactggtggtggtgtatgccctgtgaaatctgataagagcaacactggggtgtgccctgcaaaatctgacaagagcatcagtggtgtatgccctgtcactggcaaggatcatggtagcaagctcaaggaaagtggtgatcatggtgaaagaaagggcaccgatcctcgtgtcgtaccagcaaaatgcccattcggctatgactccaacactttc

SEQ ID NO: 38909 - protein, 82 aa, Zea mays
  misc_feature: Ceres CLONE 1428163-F
MSSICPFAGATTGGGVCPVKSDKSNTGVCPAKSDKSISGVCPVTGKDHGSKLKESGDHGERKGTDPRVVPAKCPFGYDSNTF

SEQ ID NO: 38910 - DNA, 640 bp, Zea mays
  misc_feature: Ceres CLONE 1428164-F
  misc_feature: Encodes the peptide sequence at SEQ ID NO. 38911
tggagctccccgcggtggcggccgctctagaactagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcgtctcgtcgggtgcccttgctgctgctggtcctgggcgtgctggtgtcgtgctccttcgcggcgggcagcttggaccaggagctggacatcacgtggggcgacgggcggggcaaggtcctggacaaccggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcagggcggcgcgcacgacgagatcgacttcgagttcctgggccacgtgtccggcgagccctacacgctgcacaccaacgtgtttcaccctgggggcaagggcaacgggaccaacaattccccctctagttc

SEQ ID NO: 38911 - protein, 138 aa, Zea mays
  misc_feature: Ceres CLONE 1428164-F
  misc_feature (28)..(138): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MATSSRRVPLLLLVLGVLVSCSFAAGSLDQELDITWGDGRGKVLDNRRLLTLSLDRTSGSGFQSRHEYLFGKIDMQLRLVPGNSAGTVTAYYLSSQGGAHDEIDFEFLGHVSGEPYTLHTNVFHPGGKGNGTNNSPSS

SEQ ID NO: 38912 - DNA, 685 bp, Zea mays
  misc_feature: Ceres CLONE 1428169-F
  misc_feature: Translation starting site: 188
  misc_feature (238)..(238): n is a, c, t, g, unknown, or other
ggagctcaccgcggtggcggccgctctagaactagtggatcccccgggctgcaggaattcgcacgagaccattacctagaacatcctaatcgaaaaaccggccaccgcgaatccagagccccacgccccgtccgaaccccagagcagagcaaagcctcctcgacctccctgtccccagccttccccgatgggccgcacgaagcagacggcgcgcaagtcgacgggcggcaggcccccncgaaagcagctggcgacaaaggcggcgccaaagtccggggccggcaacggggcgggtttaaaaaacccgcacctgttccgcccggggaacgttcccgcttccgcaagatccccaagtaccagaagaggaggggagttggtaatcccgggagcttccttttccaggggcctgggcccgggaccaccccccagaacttcaaggagggacctccgcttttcagttcctccccccttcccccctctttgaggagggcccccaaaggccaccctggggggccctttttaaaggaaccccacctttgtttccccccaccgaaaggggggtagcctttttggccccagggtaattcggtctgggggcccgcttcgggggagagggccgcgaagggggtgtcggtttggcggcccccgcctccccatcgcgcgggaagggttttatttccccccg

SEQ ID NO: 38913 - DNA, 658 bp, Zea mays
  misc_feature: Ceres CLONE 1428170-F
  misc_feature: Translation starting site: 373
aaactggagctccccgcggtggcggccgctctagaactagtggatcccccgggctgcaggaattcgcacgagaccattacctagaacatcctaatcgaaaaaatgtcgcgtgcggccatctagatttttcctgacgcggtgtctgctcccacttcccctcctctcccccaggtggcggcagcatgcggcggggtagcatttgtgctactagggcttttgcaatggctgcttctgggttccgcggcaggcgaagcgttacggctctaggctcgcgccaggggccggcttactgaagctgcacaaagacgcacatccccctctggtccgtcgactgtcgccaccgacgccatccggaatgctgctaatcagcgaatgttacccggtccaggtgttgatcgagctctacatcaagctgctccaccagatctagtacatgagtgccgaatagctccgcacctccaaccaggagttcgtcgtcctctacgagaagctcataccaccgctgcttaagagctgccggcctcgcgggtgattccactgctggccccctatatgtgatttggacaagcatccgtgagctgtcattacagaatgcctatgacagtagcttgaaacttgctcaggataatggcattcagtacatcgcattccctgctat

SEQ ID NO: 38914 - DNA, 632 bp, Zea mays
  misc_feature: Ceres CLONE 1428177-F
  misc_feature: Encodes the peptide sequence at SEQ ID NO. 38915
  misc_feature (9)..(9): n is a, c, t, g, unknown, or other
tcttatctngtggatcccccgggctgcaggaattcgcacgagaccattacctagaacatcctaatcgaaaaaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggccaccgcttctcctccgcctccgcctcgggcagccgcctcctccatgacggcgcctggcgccccttctgcatcttcacctccacccgccagcccgagcagcaccgccgccagcggcagcgaaccgccatgaacgagggcgactacaatccacccggaagccccagggcccatcccggccgggagcctcactcgtttgctgcctcccgcctgccgtggcttaatcgtccaaagtccgccgcccggcggttccctttgcccgg

SEQ ID NO: 38915 - protein, 108 aa, Zea mays
  misc_feature: Ceres CLONE 1428177-F
MAIRITVSYSGYVAQNLAASLGHRFSSASASGSRLLHDGAWRPFCIFTSTRQPEQHRRQRQRTAMNEGDYNPPGSPRAHPGREPHSFAASRLPWLNRPKSAARRFPLP

SEQ ID NO: 38916 - DNA, 716 bp, Zea mays
  misc_feature: Ceres CLONE 1428182-F
  misc_feature: Translation starting site: 162
  misc_feature: Pfam Name: Aminotran_5 Pfam Description: Aminotransferase class-V
  misc_feature: SWISSPROT Homolog: EC 2.6.1.52 Phosphoserine transaminase
ctccccgcggtggcggccgctctagaactagtggatcccccgggctgcaggaattcgcacgagaccattacctagaacatcctaatcgaaaaacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcggcgccgtccccggccgcagccgccgcggcggacgaggtggagcgcggcgtctacaacttcgcggcggggtcccgcgacgctccctctctccgtgctcaagcgggcgcaggcggagcttgtggactaccacggctccgggatgagcatcatggagatgagccaccgcggggaaggagttcgacgccgccatcaagaaggccgaagtccgacctgcgcgcgctccttcggggtgccgaaacccacgccggggtttttctcccgggggggccccccaacgcaatttggccgcgtcccggttaaactttggaaggggggcctccaaacccgggcaaattttttttgggccgggaacttgaagagaaaaagggctttaagggagggcaaaaattttccccccccctccctgccccgggg

SEQ ID NO: 38917 - DNA, 707 bp, Zea mays
  misc_feature: Ceres CLONE 1428185-F
  misc_feature: Translation starting site: 418
  misc_feature (707)..(707): n is a, c, t, g, unknown, or other
aagctggagctccccgcggtggcggccgctctataactagtggatcccccgggctgcaggaattcgcacgagaccattacctagaacatcctaatcgaaaaaatgcagcagtagccgtctgcctcctcgctttccctttcgtccgtacgccgccgcctcgcaccgccgacagtcctcagtccagaactccagatcgagcctccctctccccagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatcaggcgcttagaaggcgcgctggccggtggatgacgatggcgggtggcgggggactgaaccggtcttcatcgagggggcagctgccgccgcaagagctgcttgacgatctctgcagccggttccttctgaaatgtgccccaggaggagcttgagtcgttcgagcggatcctgttcctgctggagcaggcgcactggttctatgaggacaaccccgttgagcacaacccccacctcaagtccctctcctttaaggacttcacttcccccatggtcaaaaagctggcatggctctcccggccctaaatcgcggaccttggagaattcn

SEQ ID NO: 38918 - DNA, 637 bp, Zea mays
  misc_feature: Ceres CLONE 1428186-F
  misc_feature: Encodes the peptide sequence at SEQ ID NO. 38919
aaagctggagctccccgcggtggcggccgctctagaactagtggatcccccgggctgcaggaattcgcacgagaccattacctagaacatcctaatcgaaaaaccccgacggtgaattccccattcacatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcacgcagcagtgcgtccaggcttgcgagcgccggcgacagcagcgcggctggcacccgtgactccaacggcgactaggacaacagcaaccggcgggtgccagattaaatgccggcccccacatctatcggcaaggcgaggcaattggtgcctgacaaccctttcaaccctaaaccaaacagaggaaggaaccccccccccccaaaaaaaaaaaaaaaggaggcc

SEQ ID NO: 38919 - protein, 147 aa, Zea mays
  misc_feature: Ceres CLONE 1428186-F
MATALLRRALHLRRVLPSPAVTAAASQRLIPAFSTTPTPTPTTSQQNAATTTIDLSSDESRRRLLNRLVYRSKHAAVRPGLRAPATAARLAPVTPTATRTTATGGCQIKCRPPHLSARRGNWCLTTLSTLNQTEEGTPPPQKKKKRR

SEQ ID NO: 38920 - DNA, 676 bp, Zea mays
  misc_feature: Ceres CLONE 1428194-F
  misc_feature: Encodes the peptide sequence at SEQ ID NO. 38921
aaagctggagctccccgcggtggcggccgctctagaactagtggatcccccgggctgcaggaattcgcacgagaccattacctagaacatcctaatcgaaaaactcctcgtcgccaaaaccctagccctgcttctttgccatggcgagcagcgctagccaggcgagcctcctgctccagaagcagctcaaggatcttgcgaagaaccccgtggatgggttctccgccgggcttgtagacgacagcaacatcttcgagtggcaggtcaccatcatcggaccgcctgacaccctatatgatggaggctacttcaatgcaataatgaccttcccccagaactatcccaacagcccgccatcagtaagatttacttctgagatgtggcatccgaatgtttatcctgatggacgtgtttgcatttctattcttcatccacctggtgaagatccaatgtttataagcttgcaagcgaacaatggaccccctggcccccggttgaaaattatattctgagcaccttttccatgccccccaagcccaaatgacagggctcccccgaaaattccaaacctcccaagatttgggaaaaaaaacggggttggttcccaaaaaaagggaggggaatggtccccccaattcctcggaaaacccctaaaagaaaaaaaaattgggggggg

SEQ ID NO: 38921 - protein, 123 aa, Zea mays
  misc_feature: Ceres CLONE 1428194-F
  misc_feature (11)..(124): Pfam Name: UQ_con Pfam Description: Ubiquitin-conjugating enzyme
  misc_feature: SWISSPROT Homolog: EC 6.3.2.19 Ubiquitin--protein ligase
MASSASQASLLLQKQLKDLAKNPVDGFSAGLVDDSNIFEWQVTIIGPPDTLYDGGYFNAIMTFPQNYPNSPPSVRFTSEMWHPNVYPDGRVCISILHPPGEDPMFISLQANNGPPGPRLKIIF

SEQ ID NO: 38922 - DNA, 729 bp, Zea mays
  misc_feature: Ceres CLONE 1428197-F
  misc_feature: Encodes the peptide sequence at SEQ ID NO. 38923
aaagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtacggtcgcggcagcgagagcgcgggcaagtgccgggagaggtgcgagcgccaccaccgcggggactggtgggagaggcagcgctgcctgatgatgcaaaacccccccggggaccggaaagaagagg

SEQ ID NO: 38923 - protein, 172 aa, Zea mays
  misc_feature: Ceres CLONE 1428197-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYGRGSESAGKCRERCERHHRGDWWERQRCLMMQNPPGDRKEE

SEQ ID NO: 38924 - DNA, 573 bp, Zea mays
  misc_feature: Ceres CLONE 1428199-F
  misc_feature: Encodes the peptide sequence at SEQ ID NO. 38925
  misc_feature (99)..(99): n is a, c, t, g, unknown, or other
  misc_feature (200)..(200): n is a, c, t, g, unknown, or other
  misc_feature (211)..(211): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
ctccccgcggtggcggccgctctagaactagtggatcccccgggctgcaggaattcgcacgagaccattacctagaacatcctaatcgaaaaaaagctnagagacaaccgctgcgtaaacgaatccatcgccatggcgtctcgtctcgttgcggcggcggcctcctcctcctccctctcctcagcgtcccccctcgctcngctatctctcngcgcgccctgccggtgccgcagacggccatgggtctgcgaagtgcccttgtgaaaagatccgttgagcccgagcaagtggaaggaaagcacctttgtctaaccaagcttctcaatggggggggggtaatttttttaaggggggggtaaacaaaccttttttttgggggaaaaagaaaagagagccccccaaaaatttggggggggggggttctcccccccccccccggtattaatttgggggggggccgaaaaaaaaagaaaatttttttttttctccccccccccnnntttttttttggtggggggggccggcggcccccccttttttttttaataaaaaaaaaaaaaaaggtgttttttt

SEQ ID NO: 38925 - protein, 43 aa, Zea mays
  misc_feature: Ceres CLONE 1428199-F
  misc_feature (23)..(23): Xaa is any aa, unknown, or other
  misc_feature (27)..(27): Xaa is any aa, unknown, or other
MASRLVAAAASSSSLSSASPLAXLSLXAPCRCRRRPWVCEVPL

SEQ ID NO: 38926 - DNA, 771 bp, Zea mays
  misc_feature: Ceres CLONE 1428200-F
  misc_feature: Encodes the peptide sequence at SEQ ID NO. 38927
aagctggagctccccgcggtggcggccgctcttccactagtggatcccccgccgcggtgttgactcgcacgagaccattacctagaacatcctaatcgaaaaattcctcggagaggagaagccgccgtgttcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaacgagtctacgctccacctcgtgctgcaggctccgcggtggcctcctttatagccgtctccgctgtggtgtcctcccaaggaccaccaggaacaagatgattctgcgcaaatgccattgccccggctgccccccagggtgtgtccactggccccagaataaattgggggccccccccccccgctgaaggtccaaaaaaatacccagaacccgtgcgggtgccttctacgcactttcccggacatacgcccggttccccgccccctcccctcccctccccgcacgagcgccctcgcggtcctgtaccccctcgcaaccccccgccctcttctcccccaccccctcttcccctaccccccggccagccgccctcccgcttccccgcccgtgcccccgctcctcctgacttctcc

SEQ ID NO: 38927 - protein, 79 aa, Zea mays
  misc_feature: Ceres CLONE 1428200-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQNESTLHLVLQAPRWPPL

SEQ ID NO: 38928 - DNA, 709 bp, Zea mays
  misc_feature: Ceres CLONE 1428203-F
  misc_feature: Encodes the peptide sequence at SEQ ID NO. 38929
  misc_feature (663)..(663): n is a, c, t, g, unknown, or other
aaagctggagctccccgcggtggcggccgctctagaactagtggatcccccgggctgcaggaattcgcacgagaccattacctagaacatcataatcgaaaatttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcgtcggcgcggggcgcctcgccgacgccgcctcctccggccgcgcgtcccccgccggcgcagcttttcaactggccgggcgcccaccagccgcagctcttcccgcccggtccgggcgcgttccaccacccgtcggcgcgggcgatgccgccattgttcccaggcggcggcaaggacgagggccacatgttccacattccaccggcacaccatggcagcaagccactgcacatggacgagctccagcaccggcaccagcagacgatgggggccggtggcgaggcgcccgacggtgaactccggtggcccaacgggctgtccttcttcaccgcgctcaccgggcgagacgacgaacgcgagctgctattcngtggccccggcgcccgcgacgacgagaagcgggcgccgacgcgcaa

SEQ ID NO: 38929 - protein, 158 aa, Zea mays
  misc_feature: Ceres CLONE 1428203-F
  misc_feature (144)..(144): Xaa is any aa, unknown, or other
MRHTFESLGYQSGFFLSQLFSSARGASPTPPPPAARPPPAQLFNWPGAHQPQLFPPGPGAFHHPSARAMPPLFPGGGKDEGHMFHIPPAHHGSKPLHMDELQHRHQQTMGAGGEAPDGELRWPNGLSFFTALTGRDDERELLFXGPGARDDEKRAPTR

SEQ ID NO: 38930 - DNA, 725 bp, Zea mays
  misc_feature: Ceres CLONE 1428206-F
  misc_feature: Encodes the peptide sequence at SEQ ID NO. 38931
  misc_feature (514)..(514): n is a, c, t, g, unknown, or other
  misc_feature (612)..(612): n is a, c, t, g, unknown, or other
  misc_feature (672)..(672): n is a, c, t, g, unknown, or other
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccccacaagcacaagggcccgcgcgccccctgctccctcgccggatcccgccacgatgcccctgccgaccaccagcgcacctgccgcgagcccaagcccgtccacccacaagaagaagccctcttccgcctatcagggctccgcctccgtccacgacgcggacggggctccgcatcaagcactccctcggccagtcccacccggtcaagctcgcgcctttcagcccggaccaggaggacgcgtcggtgctgtggacggagagcaaggacgtgngcaagggcttccgctgcatccgcatggtcaacaacacccgcctcaacttcgacgccttccacggcgacaaggaccacggcggcgtgcacgacggcacnggcctcctgctcctaggagtggtgcaagggcgagaaccaaaccttgaaaatcctgcccgnntggccccaaggccaactccccccccgcccacccggaggccccgacgccctgg

SEQ ID NO: 38931 - protein, 62 aa, Zea mays
  misc_feature: Ceres CLONE 1428206-F
  misc_feature (46)..(46): Xaa is any aa, unknown, or other
MVNNTRLNFDAFHGDKDHGGVHDGTGLLLLGVVQGREPNLENPARXAPRPTPPPPTRRPRRP

SEQ ID NO: 38932 - DNA, 664 bp, Zea mays
  misc_feature: Ceres CLONE 1428207-F
  misc_feature: Encodes the peptide sequence at SEQ ID NO. 38933
aaagctggagctccccgcggtggcggccgctctagaactagtggatcccccgggctgcaggaattcgcacgagaccattacctagaacatcctaatcgaaaaagtcatcaccaagcgtctccgccgccgacgacagcgtactgtattgtagttccggagcagggttggggagagtagtagtgatccgaaatgtcgaccgaggaggctgttgtggctgatgtcccggtgacctaggtgcctgctgatgtcccggcggcccacgtggccgaggcccccaaggcgaagaaggcgcccaaggagaagaaggcgcctaaggagaagaagccgtccgcggtgaagaagccggaggcgcaccctccctacgcatgagatgattgtagaggcgatcgctgtcctcaaggagaggaaggggtcgagctcgatggccatcagcaagtacgtcgaggggaagcacggcggttagctccccaccaacttccgcaagcagctcaccgtgcagttgacgtaactcgctgcctccggtaagctgaccagggtgaagaactccttgctgctgccggccaacgacgccaagcccatggccgccaaggcccaggctacccaaggccgagcccaggcccaacccctcggctgaggtgaatggccaagaccgctgctcaacccc

SEQ ID NO: 38933 - protein, 30 aa, Zea mays
  misc_feature: Ceres CLONE 1428207-F
MIVEAIAVLKERKGSSSMAISKYVEGKHGG

SEQ ID NO: 38934 - DNA, 710 bp, Zea mays
  misc_feature: Ceres CLONE 1428208-F
  misc_feature: Encodes the peptide sequence at SEQ ID NO. 38935
aaagctggagctccccgcggtggcggccgctctagaactagtggatcccccgggctgcaggaattcgcacgagaccattacctagaacatcataatcgaaaatttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcgtcggcgcggggcgcctcgccgacgccgcctcctccggccgcgcgtcccccgccggcgcagcttttcaactggccgggcgcccaccagccgcagctcttcccgcccggtccgggcgcgttccaccacccgtcggcgcgggcgatgccgccattgttcccaggcggcggcaaggacgagggccacatgttccacattccaccggcacaccatggcagcaagccactgcacatggacgagctccagcaccggcaccagcagacgatgggggccggtggcgaggcgcccgacggtgaactccggtggcccaacgggctgtccttcttcaccgcgctcaccgggcgagacgacgacgcgaagctgctattcggtggccccggcgcccgcgacgacgagaaggcggcgccggacgcgcaa

SEQ ID NO: 38935 - protein, 159 aa, Zea mays
  misc_feature: Ceres CLONE 1428208-F
MRHTFESLGYQSGFFLSQLFSSARGASPTPPPPAARPPPAQLFNWPGAHQPQLFPPGPGAFHHPSARAMPPLFPGGGKDEGHMFHIPPAHHGSKPLHMDELQHRHQQTMGAGGEAPDGELRWPNGLSFFTALTGRDDDAKLLFGGPGARDDEKAAPDAQ

SEQ ID NO: 38936 - DNA, 689 bp, Zea mays
  misc_feature: Ceres CLONE 1428211-F
  misc_feature: Encodes the peptide sequence at SEQ ID NO. 38937
  misc_feature (574)..(574): n is a, c, t, g, unknown, or other
aagctggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagcagagcctgcctctgttctgcaggtgggcgccgcgtgacgncgggcggcaggggaggaagagctgctggtggtgtcggcggctggacccgagacgtgggcgccaacgacgcgtgctcgtctacaacttctgtcggcgcgtgcgccccgcccgccag

SEQ ID NO: 38937 - protein, 161 aa, Zea mays
  misc_feature: Ceres CLONE 1428211-F
  misc_feature (3)..(50): Pfam Name: F-box Pfam Description: F-box domain
  misc_feature (124)..(124): Xaa is any aa, unknown, or other
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPPPGPSRACLCSAGGRRVTXGGRGGRAAGGVGGWTRDVGANDACSSTTSVGACAPPA

SEQ ID NO: 38938 - DNA, 701 bp, Zea mays
  misc_feature: Ceres CLONE 1428214-F
  misc_feature: Encodes the peptide sequence at SEQ ID NO. 38939
  misc_feature (686)..(686): n is a, c, t, g, unknown, or other
  misc_feature (701)..(701): n is a, c, t, g, unknown, or other
aagctggagctccccgcggtggcggccgctctagaactagtggatcccccgggctgcaggaattcgcacgagaccattacctagaacatcctaatcgaaaaacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacggagaagaaggacgacgcggtggtgcagccgcagaccttcccgcccttcgaccgcctcggcgacggcgcgtccccggcgttcggcggcctccccggcggcagcattcctggcagcagcattcccgggttcagcatgcccggcagcggcagcagcctacccgggttcagctttgcccgcagcggcagcatgccccctctcggcggcggctccccgggcttcagcggcttcggcggcatgcccgggtcccccaccgccggctccgtccccgagcacgccaaacagccctgaaacgccacagcgtggtagtaagaagggtgctactgntactgtagtacgtcn

SEQ ID NO: 38939 - protein, 128 aa, Zea mays
  misc_feature: Ceres CLONE 1428214-F
MARSSKMMVAAALLALALAVSIAEARNIKTTTTEKKDDAVVQPQTFPPFDRLGDGASPAFGGLPGGSIPGSSIPGFSMPGSGSSLPGFSFARSGSMPPLGGGSPGFSGFGGMPGSPTAGSVPEHAKQP

SEQ ID NO: 38940 - DNA, 736 bp, Zea mays
  misc_feature: Ceres CLONE 1428216-F
  misc_feature: Encodes the peptide sequence at SEQ ID NO. 38941
  misc_feature (405)..(405): n is a, c, t, g, unknown, or other
  misc_feature (407)..(407): n is a, c, t, g, unknown, or other
  misc_feature (412)..(412): n is a, c, t, g, unknown, or other
aagctggagctccccgcggtggcggccgctctagaactagtggatcccccgggctgcaggaattcgcacgagaccattacctagaacatcctaatcgaaaaatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacgggccgaggggagagagcgccncnagcangaggccgagacaaagactcgccgccgccggggacggccccagcgccgccgcgaccccgggagcgaggatgaagagccccaagagctagaactgcaaacggaggatccccgtgaggaggagatccccggaggcgggcccgtaatctgtaggggacccggtcaagatccctgccaggggaaaaaaccaaaaaaaccttttgcttccttcaaggtcaggggcaacaccttcaggtttggagacccccgggtttttcccccctaggggacggaattcaaaaccccttttggcccccttccccggggtataaaacaaaaccgtgggggg

SEQ ID NO: 38941 - protein, 173 aa, Zea mays
  misc_feature: Ceres CLONE 1428216-F
  misc_feature (85)..(85): Xaa is any aa, unknown, or other
  misc_feature (86)..(86): Xaa is any aa, unknown, or other
  misc_feature (87)..(87): Xaa is any aa, unknown, or other
MGRRRRFAQLDDDDDDDEDVPINFKPSGGASSSDAKPRKPQPPPQQRRGVSDDDDEDVEEVELEEEEDDEKDLEAMRRAEGRERXXXEAETKTRRRRGRPQRRRDPGSEDEEPQELELQTEDPREEEIPGGGPVICRGPGQDPCQGKKPKKPFASFKVRGNTFRFGDPRVFPP

SEQ ID NO: 38942 - DNA, 699 bp, Zea mays
  misc_feature: Ceres CLONE 1428221-F
  misc_feature: Translation starting site: 292
  misc_feature: SWISSPROT Homolog: EC 3.1.3.16 Phosphoprotein phosphatase
  misc_feature (400)..(400): n is a, c, t, g, unknown, or other
  misc_feature (401)..(401): n is a, c, t, g, unknown, or other
  misc_feature (517)..(517): n is a, c, t, g, unknown, or other
aaagctggagctccccgcggtggcggccgctctagaactagtggatcccccgggctgcaggaattcgcacgagaccattacctagaacatcctaatcgaaaaagacaaaacagcgtccccctccctctactaaaaaaaaaatggaggcatgagctccgcctcctcctcgtctctcgccgatctccccaaaccctagccccgacctgaccgccggcgggcccgccggccggagaaggagtcgctcccacccacccaacttctgcggcggaaggggagcgggcggcggacgagatgccgtcgcacggggatctggaccggcagatcgcgcagctgcgcgactgcaagtacctgcccgaagcggaggtcaaggcgctctgcgagcaggccaaggccatccttnnatgagagtggaacgtgcagcccgtgcgctgtcctgtcaccgtctgtggcgacttcacggccaggtctatgacctcatcgaggtctttccgatcgggggggacgttcccgacacaanttacttcttcagggggactacgtcgatcggggctactattcagccaaaacagttccccctgtaggggcttttaaaaagcccgttccaaaaatggaattccaatctttagggaaaaccttggaggccaaacaatcccccccggttttggggcttcctggaagaaaaggctaaaaaaaattggg

SEQ ID NO: 38943 - DNA, 736 bp, Zea mays
  misc_feature: Ceres CLONE 1428226-F
  misc_feature: Encodes the peptide sequence at SEQ ID NO. 38944
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtacggtcgcggcagcgagagcgcgggcaagtgccgggagaggtgcgagcgccaccaccgcggggactggtgggagaggcagcctgcctgaggaaaaacccccccccccccgggggcggaaaaaaggaggccg

SEQ ID NO: 38944 - protein, 159 aa, Zea mays
  misc_feature: Ceres CLONE 1428226-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYGRGSESAGKCRERCERHHRGDWWERQPA

SEQ ID NO: 38945 - DNA, 726 bp, Zea mays
  misc_feature: Ceres CLONE 1428234-F
  misc_feature: Encodes the peptide sequence at SEQ ID NO. 38946
aaagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcatccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaagagtggcccccgtgaggatgccacccgtattggttccgctggtgttgtgagaagggaggacgtggatatctcacccctgatgagggtgaaccaggccatctacctcctcaccactggtgccagggagagtgctttccggaacatcaaaacattggccaagggccctgcagaagaactggaccacgccgcccagg

SEQ ID NO: 38946 - protein, 177 aa, Zea mays
  misc_feature: Ceres CLONE 1428234-F
  misc_feature (44)..(177): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIIKSGPREDATRIGSAGVVRREDVDISPLMRVNQAIYLLTTGARESAFRNIKTLAKGPAEELDHAAQ

SEQ ID NO: 38947 - DNA, 625 bp, Zea mays
  misc_feature: Ceres CLONE 1428244-F
  misc_feature (17)..(17): n is a, c, t, g, unknown, or other
  misc_feature (35)..(35): n is a, c, t, g, unknown, or other
  misc_feature (48)..(48): n is a, c, t, g, unknown, or other
  misc_feature (50)..(50): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (91)..(91): n is a, c, t, g, unknown, or other
  misc_feature (96)..(96): n is a, c, t, g, unknown, or other
  misc_feature (97)..(97): n is a, c, t, g, unknown, or other
  misc_feature (117)..(117): n is a, c, t, g, unknown, or other
  misc_feature (555)..(555): n is a, c, t, g, unknown, or other
tttgtgtgggtggtgtntttgtgggttggggtggnggggggtgtgttncncctcctnnntnnnnaccgcgcgcctctccggtgtgaggggnggggnnccaaagctggaagctccccncgggtggcggccgctctagaactagtgggatcccccgggctgcaggaattcgcacgagaccattacctagaacatcctaatcgaaaaaaaaaataaaaagaaaaaaaataaaaaaaagagaggaaaaggggacaaaccaccaacaacaaccagaatatcgcatcgccgtcgcgtcgtcgtcgatctccccgccccgccccgcccgcgccgcggaatctgacacatctccctaatctctcctaggaccgggtggccctacatccacgccgcaacgcaaatcgccggtccgagccctcgcggtctctcgtcttcccgtggcgagaggacgccggcaagcagcgggcgggcccaaggcggggggcttgggggggggaaaaaccgggaggcggggggaaaaattccgcccccaaaggggcacggaaaggccctgttccccgncctccccttgggggaaaaaggcaaaaaaccccccccggggaaggggccacaggggaaaaaaaacccccgg

SEQ ID NO: 38948 - DNA, 670 bp, Zea mays
  misc_feature: Ceres CLONE 1428254-F
  misc_feature: Encodes the peptide sequence at SEQ ID NO. 38949
tcccccgggctgcaggaattcgcacgagaccattacctagaacatcctaatcaaaaaaaaacacacagcaagattccacgagaaccgtcaatgggttctataggaggacacacaaccacagctaccgccgaccggcgccgccgcgtgctgttcttcccgctcccgtaccagggccacatcaaccccatgttccaactcgccggcctcctccacttgcgcggtttctccgtcaccgtcttccacaccgacttcaacgctcccgacaagtcccgccaccctgcctacgacttcgtccccgttcccgtccgcggctgcttgccgaagggcagctcggatgccttgcaggtgaccgtggagcgcatcctcgtcgtgaaccgcgcctgcgaggctccgttccgggagcgcctggccgctctgctggcgcgggaggacgtcgcgtgcctggtcgctgacgcccacctgctgacgctgctggacgtggcgcgggggctcggcgtgccgacgctggtgctgcgcaccggcagcgcggcgtgcctccgcatgttcgcggcgttccccgcgctctgcgacaaggggtatcagccggcgcaagagtcccagctgggagcgctggtgactgagctgccgccgtaccgcgtccgggaactgccgtccaccaaccagcgctgcc

SEQ ID NO: 38949 - protein, 193 aa, Zea mays
  misc_feature: Ceres CLONE 1428254-F
  misc_feature: SWISSPROT Homolog: EC 2.4.1.218 Hydroquinone glucosyltransferase
MGSIGGHTTTATADRRRRVLFFPLPYQGHINPMFQLAGLLHLRGFSVTVFHTDFNAPDKSRHPAYDFVPVPVRGCLPKGSSDALQVTVERILVVNRACEAPFRERLAALLAREDVACLVADAHLLTLLDVARGLGVPTLVLRTGSAACLRMFAAFPALCDKGYQPAQESQLGALVTELPPYRVRELPSTNQRC

SEQ ID NO: 38950 - DNA, 762 bp, Zea mays
  misc_feature: Ceres CLONE 1428255-F
  misc_feature: Encodes the peptide sequence at SEQ ID NO. 38951
aaagctggagctcaccgcggtggcggccgctctattaactagtggatcccccgggctgcaggaattcgcacgagaccattacctagaacatcctaatcgaaaaatatcgaccctgccatctcctcaccctcgttaaccacacagtccgactctcctttagtaggcttgtgatttgtacgtcgaccagatcgctggtggggtggccgacgacgacacatggggaagggtagtgtgggtgcatcagggtgggcctacctcctgctcgccggcgcgctgctggtcgtaaccgccaccgccgggatggaggaccccatgtcctaacgctacctcaaggaagacctgagtcggtgcaagcatgtttagctatttgcacctcggaaaaggaggggggggggaagacggaatgctggagccagtgtcgcggcctttaaccggcaagatgacgcgggccaagacggctaccggcgcctggtacccccaaatcttcctttccagggagtgggcaaggccggcccccctttccggccctgcctcgtgggtgtgcgtgggggcccccggggggggcaggaggggggtgccttttccgggggatggccccccccgtttgaagataattttgtttctctttaacaccaacaggcccccccataccccagacaggtgagttgtacacttccccacggtgcatcgggccgagggagcggaaggtgatttgacccgctgtgttatactcgaacggttgaagtgttctcgtcccccccc

SEQ ID NO: 38951 - protein, 34 aa, Zea mays
  misc_feature: Ceres CLONE 1428255-F
MGKGSVGASGWAYLLLAGALLVVTATAGMEDPMS

SEQ ID NO: 38952 - DNA, 675 bp, Zea mays
  misc_feature: Ceres CLONE 1428258-F
  misc_feature: Encodes the peptide sequence at SEQ ID NO. 38953
gctcttaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtctcagcccgccgtggcgccggcgtccacggagaggcaggcgcccgccgcggcgttgcaggggttcctgtgcctggaggaggtggacgggaggcggtggagctacgtggtggacggtggggccgcgaaggggaggagcatgggcggggccgtccccgctggggccgccgtcagggccgtgccgctgcagtcgccgcttccgcctgccgaggaaataatggcattcataagatcatatgtggtgccctgaagggtttccagacagggttactccttcatatgtacccttacctgacctgggagggttctgaaagcatttcttttgggggaagcgattgggagt

SEQ ID NO: 38953 - protein, 117 aa, Zea mays
  misc_feature: Ceres CLONE 1428258-F
MAPAVGLKRSATQTITLPPPDTRLAVRDVMRSTIPSQPAVAPASTERQAPAAALQGFLCLEEVDGRRWSYVVDGGAAKGRSMGGAVPAGAAVRAVPLQSPLPPAEEIMAFIRSYVVP

SEQ ID NO: 38954 - DNA, 687 bp, Zea mays
  misc_feature: Ceres CLONE 1428259-F
  misc_feature: Encodes the peptide sequence at SEQ ID NO. 38955
cggccgctctataactagtggatcccccgggctgcaggaattcgcacgagaccattacctagaacatcctaatcgaaaaattggataattcgatggctctgttcaatgccctcttggttgtggtgaaccttacggcgaagggccttagttgagatgccgccagagatgtctgctccgtccgccccaccccgcacggtgatctgtgtgagcgacgtacacggctacatcacgaagctggagagcctctggtccaacctccaggccgcactccccgccgacgccttcaccaccacgctggtcatcttcctcggctactacgactaccgcggcccgtacacccgcagggtcctcgacttcctcctcgcgctcccgacgcgctaccccgcgaagagccacttcttcctctgcggcaaccactacctctccttcgcggcgttcgtcggggtgctgccgccgccgtccgactgttccccgttctcggccaactgggacgagtacatccacaaccagagacacgatgggtggttcatcgtgccgggattcgagggcatgcacatgcacgagaggctgtgaggcaggatcatctaggagaggtggtacactgagaaaggtctcccgtacaatggctccatctatgacttgcagcccatcgtagagtcatatggcgtcgcccatggatactctgat

SEQ ID NO: 38955 - protein, 135 aa, Zea mays
  misc_feature: Ceres CLONE 1428259-F
MSAPSAPPRTVICVSDVHGYITKLESLWSNLQAALPADAFTTTLVIFLGYYDYRGPYTRRVLDFLLALPTRYPAKSHFFLCGNHYLSFAAFVGVLPPPSDCSPFSANWDEYIHNQRHDGWFIVPGFEGMHMHERL

SEQ ID NO: 38956 - DNA, 713 bp, Zea mays
  misc_feature: Ceres CLONE 1428260-F
  misc_feature: Translation starting site: 171
gctctagaactagtggatcccccgggctgcaggaattcgcacgagaccattacctagaacatcctaatcgaaaaacaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcccgcgtgtccgtcgatgtcaccaactcctacgcccgtgccgtttgagggaggatgacaaggatcctaggatctggttccttgaccacaattaccacgagtcaatgttctccatgttcaagaggattaatgccaaggagcatgtggttggctgggacagcactggccccaaactaaggggagaacgaacttggatgtccctgcctttattcacagttatgtgcctaatccagtcttggtgattatttgatgtccaaccccaagggagctgggtataccgacctaagacgtactatcccttttggaggagggtcaaagagcaatgcaccttcaaaaaagtcggaaggggatttttgtccttggtcccttcgaaaaattggccggctccatgaa

SEQ ID NO: 38957 - DNA, 674 bp, Zea mays
  misc_feature: Ceres CLONE 1428268-F
  misc_feature: Translation starting site: 482
  misc_feature: SWISSPROT Homolog: EC 1.1.1.1 Alcohol dehydrogenase
aagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagctcggtctggaga

SEQ ID NO: 38958 - DNA, 704 bp, Zea mays
  misc_feature: Ceres CLONE 1428271-F
  misc_feature: Encodes the peptide sequence at SEQ ID NO. 38959
tccccgcggtggcggccgctctagatctagtggatcccccgggctgcaggaattcgcacgagaccattacctagaacatcctaatcgaaaaaatgtcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggtaaaacctcccccgcgctccggccatgcgccggcgccgcagccgcttgccatcgagcagccatggctcacgatcgacgctctgtgtgtctgcgtgcgtggtttgcaggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacatcgaagcaaggcctgcggcggctgctggacggggtccactac

SEQ ID NO: 38959 - protein, 159 aa, Zea mays
  misc_feature: Ceres CLONE 1428271-F
  misc_feature (52)..(158): Pfam Name: Cofilin_ADF Pfam Description: Cofilin/tropomyosin-type actin-binding protein
MAMAYKMVKPPPRSGHAPAPQPLAIEQPWLTIDALCVCVRGLQATEGMNVKEECQRWFMEMKWKKVHRFVVYKIDERSRAVLVDKVGGPGEGYEELVAALPGDDCRYAVFDFDFVTVDNCQKSKIFFIAWSPAASRIRAKILYATSKQGLRRLLDGVHY

SEQ ID NO: 38960 - DNA, 690 bp, Zea mays
  misc_feature: Ceres CLONE 1428278-F
  misc_feature: Translation starting site: 123
  misc_feature: SWISSPROT Homolog: EC 1.11.1.15 Peroxiredoxin
  misc_feature (421)..(421): n is a, c, t, g, unknown, or other
  misc_feature (423)..(423): n is a, c, t, g, unknown, or other
aaaactggagctccccgcggtggcggccgctctagaactagtggatcccccgggctgcaggaattcgcacgagaccattacctagaacatcctaatcgaaaactcatccactccggggggccatggcctgctccttctccgccgccatcaccgtctcttccgcccctaccccgggcgccagacccctcgctgctgccacgcagtccgtctgcatcgctcgctccgcggtcgccaccactgccaggccgctccgcctcgccgcctcaagggccgcgcgggctaccagactcgttgcccgcgccagcgtagtcgatgacttgccgctggtcgggaacagggcgccagacttcgaggccgaggctgtgttcaaccacgagttcatcagggggagggtggctgattacatttgggaaaaagtacngntcattctgttcttctaccgccttggatttcacccttcgtctggccgacccgagattactggcgtttagtggcagatacgagggaaatttgagaagttgaacactggaggttcttggtgtttccatttgacagtggggttctcccacctttgcatgggtgcagacagacagggaagtcgggtggcctccgccaatcttaatacccacgtggtttctaatgggaccaaatcaatttcaaaggggctttggtgttctaatcccctgacag

SEQ ID NO: 38961 - DNA, 581 bp, Zea mays
  misc_feature: Ceres CLONE 1428280-F
  misc_feature (143)..(143): n is a, c, t, g, unknown, or other
  misc_feature (395)..(395): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (541)..(541): n is a, c, t, g, unknown, or other
aaagctggagctccccgcggtggcggccgctctagaactagtggatcccccgggctgcaggaattcgcacgagaccattacctagaacatcctaatcgaaaagacgacactgcacacctctcaccagtccccacacggccacnaccacacccagctgtccccatcgcgcgcacactctctcggtctctccctcccagtcccagcgtttgcggtccagtccagagagctcgaggcagcccatgggcgggctccccctggtcctcctccctctgctgctggctatgttcaaaagggtcagcagaacccggcgtttctggggttgcaaaaaaagggggggggcccacaacagggaatgcgggggggaattaaataccccccgccccaagagggggggnaaaaaatgcccccccccccccaagggggccccccttttaaaaaaaaaaaaaaaaggggggggtttttttttctctttttgggaaaaaattttcataagagaaaccccccccccccccgcgggggggnnnnnnnnnnnnnnnnncgngagaaaaaaaaaaaaaaagaaggggccccccccccccccc

SEQ ID NO: 38962 - DNA, 673 bp, Zea mays
  misc_feature: Ceres CLONE 1428288-F
  misc_feature: Encodes the peptide sequence at SEQ ID NO. 38963
  misc_feature (452)..(452): n is a, c, t, g, unknown, or other
aagctggagctccccgcggtggcggccgctctagaactagtggatcccccgggctgcaggaattcgcacgagaccattacctagaacatcctaatcgaagaaattggcgacgaagcaaggaacgcaccccgaatcccaactcctgtgtccgccatcgcctcgtggcggtcgctcctgctcctcctgctgctgctgctccccagccgctcccgcccggagcacgccgccggcgccgacgtcggcgcgtcgcatggatatggcccccgcgtctgtctacttcaatccgcgctcggtcgaggaaatcttcaaggacttctccggccgccgcgcggggctcgtccgcgccctcacctccgatgtggacgatttctgcagcttgtgcgacccagataaggagaatttgtgtctctacggccttcccaaaacggagctgggaggtgtcgccgccggcngaggaggttcctccggagttgcccgagccggcgctcggcatcaacttttgcgcgcgacggcatgcagcgccgcgactggctcacactcgtcgccgtccactctgactcgtggctcatctcggtcgcattcttctacggtgcccgcctcaacggcaacgaccggaagcgcttgtcagcatgatgagtgatcttcctttccgtctagagcatcgcggacagaa

SEQ ID NO: 38963 - protein, 129 aa, Zea mays
  misc_feature: Ceres CLONE 1428288-F
  misc_feature (68)..(68): Xaa is any aa, unknown, or other
MDMAPASVYFNPRSVEEIFKDFSGRRAGLVRALTSDVDDFCSLCDPDKENLCLYGLPKTELGGVAAGXGGSSGVARAGARHQLLRATACSAATGSHSSPSTLTRGSSRSHSSTVPASTATTGSACQHDE

SEQ ID NO: 38964 - DNA, 725 bp, Zea mays
  misc_feature: Ceres CLONE 1428291-F
  misc_feature: Encodes the peptide sequence at SEQ ID NO. 38965
  misc_feature (373)..(373): n is a, c, t, g, unknown, or other
  misc_feature (412)..(412): n is a, c, t, g, unknown, or other
  misc_feature (449)..(449): n is a, c, t, g, unknown, or other
  misc_feature (451)..(451): n is a, c, t, g, unknown, or other
ccccgcggtggcggccgctctagatctcgtggatcccccgggctgcaggaattctcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccccgcatccggtggtggacctctcggtgnacgcgcgcgaggacctagtcgagcagggtgagcacgcgnccgggacggtgggcttcttctggctggtgaacaacgnantgcccgaagagctgatgggccgcatgctccgcggggtgccccagttcaccgagggcccccgtggaagccaaccagggcccttaccccgagggaacttgttggaaacctgggctttcccctccaatttgacctctttaaaaggtttttgggccccaatggggccacccccctttttttggagaggggccccacaacccccccccccgggggagactctccggacccctctgagaacgtttttttgggaaaaccccgggggggagaaaaatgtggg

SEQ ID NO: 38965 - protein, 196 aa, Zea mays
  misc_feature: Ceres CLONE 1428291-F
  misc_feature: SWISSPROT Homolog: EC 1.14.11.20 Desacetoxyvindoline 4-hydroxylase
  misc_feature (80)..(80): Xaa is any aa, unknown, or other
  misc_feature (93)..(93): Xaa is any aa, unknown, or other
  misc_feature (105)..(105): Xaa is any aa, unknown, or other
  misc_feature (106)..(106): Xaa is any aa, unknown, or other
MAPTTATKDDSGYGDERRRELQAFDDTKLGVKGLVDSGVKSIPSIFHHPPEALSDIISPAPLPPSPPSGAPHPVVDLSVXAREDLVEQGEHAXGTVGFFWLVNNXXPEELMGRMLRGVPQFTEGPRGSQPGPLPRGNLLETWAFPSNLTSLKGFWAPMGPPPFFWRGAPQPPPPGETLRTPLRTFFWENPGGEKNV

SEQ ID NO: 38966 - DNA, 748 bp, Zea mays
  misc_feature: Ceres CLONE 1428303-F
  misc_feature: Encodes the peptide sequence at SEQ ID NO. 38967
  misc_feature (336)..(336): n is a, c, t, g, unknown, or other
  misc_feature (367)..(367): n is a, c, t, g, unknown, or other
  misc_feature (414)..(414): n is a, c, t, g, unknown, or other
aaagctggagctccccgcggtggcggccgctctagaactagtggatcccccgggctgcaggaattcgcacgagaccatacctagaacatcctaatcgaaaaaactactccgtcactttgtttacaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacagggggccgacngcgtcgcaggcgctgacggtggtgacgctgntcccgctggggcggctgctgctggtgctgtcggggctggccctgacngcctccgtgggggggcttgccgttgccaccccgggggtccctaattttcagcccggtgctgtccccccccgggttgttaatggggaaaggccgtcatgggggttcccccactccggggccccctggggccccgggggcgcttcccccccctcaggggccccccaaaaagggggggggagggttttcccaccccccccggaaaaatgggggagaagagccccccccccggaggggggggaaaggcccgtcccacccggggccacaaaaaacccccgaggggggcgccccccccttcccggggggggggcccaaaaaacccccccccccggggaaa

SEQ ID NO: 38967 - protein, 181 aa, Zea mays
  misc_feature: Ceres CLONE 1428303-F
  misc_feature (55)..(55): Xaa is any aa, unknown, or other
MADRDRSGIYGGAHATYGQQQQQGGGGRPMGEQVKGMLHDRGPTASQALTVVTLXPLGRLLLVLSGLALTASVGGLAVATPGVPNFQPGAVPPRVVNGERPSWGFPHSGAPWGPGGASPPSGAPQKGGGRVFPPPPEKWGRRAPPPEGGERPVPPGATKNPRGGRPPLPGGGAQKTPPPGE

SEQ ID NO: 38968 - DNA, 748 bp, Zea mays
  misc_feature: Ceres CLONE 1428316-F
  misc_feature: Encodes the peptide sequence at SEQ ID NO. 38969
aaagctggagctccccgcggtggcggccgctctagaactagtggatcccccgggctgcaggaattcgcacgagaccattacctagaacatcctaatcgaaaagcgtttcctatcgtttcggttcggcgcaggcgccgctaccgcctcctctcgaccgctcgccttcccgttcgccatgtcgttgctcgccgcggccattcccagcacttcctcccacttctccgcacccttcctcccctccttccgcatgccccgcaagaacctcaccgccccactccaccggatccgccgtccgcggccgttcaccgtcgtctcctccgtcccagaccccgcggcggggccggtggaatacacgccctggctcatcgccggcctcggcaacccaggcaacaagtactacggcacgcggcacaatgtggggtttgagatggtggatcgcatcgcgggggaggaggggattacgatgaacacagtccagtccaagtcgcttctgggaattggttcaattggcgaggtgccagtcttggtggtaaaaccgcaatcatacatgaactacagtggagaggcaattggacctcttgcagcctattatcaagtaccattacggcacatcctcttgatttatgatgatacaagtctgcccaatggtggtctgcggcctccataagaaaagggggcatggcctcccccaacgggctacaaataggtgattgaaccttttggaagggtcgcgaataatttcccctcg

SEQ ID NO: 38969 - protein, 163 aa, Zea mays
  misc_feature: Ceres CLONE 1428316-F
  misc_feature (63)..(164): Pfam Name: Pept_tRNA_hydro Pfam Description: Peptidyl-tRNA hydrolase
  misc_feature: SWISSPROT Homolog: EC 3.1.1.29 Aminoacyl-tRNA hydrolase
MSLLAAAIPSTSSHFSAPFLPSFRMPRKNLTAPLHRIRRPRPFTVVSSVPDPAAGPVEYTPWLIAGLGNPGNKYYGTRHNVGFEMVDRIAGEEGITMNTVQSKSLLGIGSIGEVPVLVVKPQSYMNYSGEAIGPLAAYYQVPLRHILLIYDDTSLPNGGLRPP

SEQ ID NO: 38970 - DNA, 674 bp, Zea mays
  misc_feature: Ceres CLONE 1428320-F
  misc_feature (544)..(544): n is a, c, t, g, unknown, or other
  misc_feature (565)..(565): n is a, c, t, g, unknown, or other
  misc_feature (591)..(591): n is a, c, t, g, unknown, or other
  misc_feature (592)..(592): n is a, c, t, g, unknown, or other
  misc_feature (596)..(596): n is a, c, t, g, unknown, or other
  misc_feature (638)..(638): n is a, c, t, g, unknown, or other
  misc_feature (648)..(648): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtcccagctacacacgggatgctactaactagctgcaaggcaaggcgaagaatggccagccttttcatgtgctccgggcggacggggttgtcccgttccggggccttttggcccccaagattttttgttgttgggccagcttgttgttttttcctaagggggggtctcccctttccaaaaaaaaaaaaagggccagagggttttttttttctcccccccccaaattttcctccccccccttttttttcgaagagagggngagagaatctatttttttttnacacaggggcgccccccccgcgcccnncccncccccccctttttaatattatacgggcggggggggggcgcgncccgcccccncccccanaaacaccgcagggaggggc

SEQ ID NO: 38971 - DNA, 768 bp, Zea mays
  misc_feature: Ceres CLONE 1428323-F
  misc_feature: Encodes the peptide sequence at SEQ ID NO. 38972
  misc_feature (36)..(36): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
ttgggttgtggttgggtgtggtgtagcccccccccncnccccacnnaaatataaaaggggtgctcaccgcggtggcggccgctctagaactagtggatcccccgggctgcaggaattcgcacgagaccattacctagaacatcctaatcgaaaacccgttccaactcctacctacgcagcagaggccagccacctccccgtcgctctcacgctcttcgtgcccgccgcctctcctccgtctctgcctctctccctctcccctcccgtctgacgcacatggcctccatcgccggatcttcggccctctccttcgccaggcccgtcaagggaatcaacacaaattctctagctttctccccggcgaggaagggcaacacattcctccgcctgcaaccgatgcctagtgagatctgtttcctgcgctgccaagaaggataccacatacgaggtttgtgagattgtgaagaacccgcttggtgtgtttgtggagttgcccccccccccgcggcgtatcgaacttctctgaactgggggccgatatcctggacgctgattgagaatcgagcaagagcctgcaagagaccaccttctatttttaaccggcgcggggaggccgaccgcaccaaaacgaattctgtggaagttcgaaaaaacactctcggcaaccttgcttcccagcaagtcttggttggcctgggtcgaaggcggtgagggttctttttacccctcccttcgaaaccggtttgtccctaactcccttccttatag

SEQ ID NO: 38972 - protein, 59 aa, Zea mays
  misc_feature: Ceres CLONE 1428323-F
MASIAGSSALSFARPVKGINTNSLAFSPARKGNTFLRLQPMPSEICFLRCQEGYHIRGL

SEQ ID NO: 38973 - DNA, 694 bp, Zea mays
  misc_feature: Ceres CLONE 1428331-F
  misc_feature: Encodes the peptide sequence at SEQ ID NO. 38974
gctccccgcggtggcggccgctctagatctcgtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactacggccgcgcgctcgcgctccccggggtctgccgcgtcgccaccccgcccgtctccacctgcacag

SEQ ID NO: 38974 - protein, 138 aa, Zea mays
  misc_feature: Ceres CLONE 1428331-F
  misc_feature (58)..(137): Pfam Name: Tryp_alpha_amyl Pfam Description: Protease inhibitor/seed storage/LTP family
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADSYGIAVDYGRALALPGVCRVATPPVSTCT

SEQ ID NO: 38975 - DNA, 620 bp, Zea mays
  misc_feature: Ceres CLONE 1428338-F
  misc_feature: Encodes the peptide sequence at SEQ ID NO. 38976
  misc_feature (531)..(531): n is a, c, t, g, unknown, or other
ggagctccccgcggtggcggccgctctagaactagtggatcccccgggctgcaggaattcgcacgagaccattacctagaacatcctaatcgaaaatcgcacgagacaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcacccactangttcattgaactctgcttcttatttgcaacaacaacaactaccattcagccagctacctgctgcctacccccagcaattttctccattt

SEQ ID NO: 38976 - protein, 124 aa, Zea mays
  misc_feature: Ceres CLONE 1428338-F
  misc_feature (122)..(122): Xaa is any aa, unknown, or other
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFTHXVH

SEQ ID NO: 38977 - DNA, 664 bp, Zea mays
  misc_feature: Ceres CLONE 1428351-F
  misc_feature: Translation starting site: 207
  misc_feature (285)..(285): n is a, c, t, g, unknown, or other
  misc_feature (286)..(286): n is a, c, t, g, unknown, or other
  misc_feature (329)..(329): n is a, c, t, g, unknown, or other
  misc_feature (338)..(338): n is a, c, t, g, unknown, or other
  misc_feature (347)..(347): n is a, c, t, g, unknown, or other
  misc_feature (369)..(369): n is a, c, t, g, unknown, or other
  misc_feature (442)..(442): n is a, c, t, g, unknown, or other
caaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcaggaaggaagcnngcgcccgatgggtgagcaggtgaagggcatgctccacgaacangggccgacngcgtcccangcgctgacggtggcgacccctntccccgctgggccggctgcctgctgtgctgtcggggctggcgcttacgcctccctggttggggctggccgtgnccaccccggtgtttctgatcttcaagcccgtgcttggtccccggcgcgcttggtcatcgggaacggcgtcatgggggtcctcaaactccgggcgcgctggggctctgggggctgtccttctctcacgtggcctcggcaaaacgggggcgggaaagggttcccaacccacccccggactatactggaaggagccccaccccaggaatggccgaaagccccccc

SEQ ID NO: 38978 - DNA, 793 bp, Zea mays
  misc_feature: Ceres CLONE 1428356-F
  misc_feature: Encodes the peptide sequence at SEQ ID NO. 38979
  misc_feature (8)..(8): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (278)..(278): n is a, c, t, g, unknown, or other
ggggtttnggnnggnnnnnntgggtgggggggggcnnnnnccttgattgtttataaaactggagctccccgcggtggcggccgctctagaactagtggatcccccgggctgcaggaattcgcacgagaccattacctagaacatcctaatcgaaaagagaaggaaaagacaattttctcgtaaccttccgggctcctcttcctctcctcgcgttcccccaccaaaccctaatccgagcacccagcccctacccgcttccgctcgcgccggcctttggnggctctcacccgtgagcggtaggaatccgcacggctccggttgggtgccagaagcatccaagtcgttggcgggagacccgggaatgggcgggaaaaaagagggggccaaaaggttggggccggaagagaattgaagaagcgggaaaccaggaaagggaaggccggagggaggtgggaaggttaaatttttccttctccttcgaagggcgtcccaaaaattggggcccccgttggggtttggaaatagggccagcccaacgacgccaaccggttttgggcccccctctctggaaaaggaaatttcgcctggtcctctctccccccgatcatgtggccctcccccctgggtttttaaaacacccacagtgttttaccccccaccggaaaagaaacgcgcctccaacacgggggggcggggaagaaaagaccctgggttaattggcgggcggggggcgggcccccaaaatggggtgtttctcattagaggaaggggaacccctccaaaatatattatg

SEQ ID NO: 38979 - protein, 60 aa, Zea mays
  misc_feature: Ceres CLONE 1428356-F
  misc_feature (3)..(3): Xaa is any aa, unknown, or other
  misc_feature (4)..(4): Xaa is any aa, unknown, or other
  misc_feature (6)..(6): Xaa is any aa, unknown, or other
  misc_feature (7)..(7): Xaa is any aa, unknown, or other
  misc_feature (13)..(13): Xaa is any aa, unknown, or other
  misc_feature (14)..(14): Xaa is any aa, unknown, or other
GVXXGXXGWGGAXXLIVYKTGAPRGGGRSRTSGSPGLQEFARDHYLEHPNRKEKEKTIFS

SEQ ID NO: 38980 - DNA, 733 bp, Zea mays
  misc_feature: Ceres CLONE 1428358-F
  misc_feature: Encodes the peptide sequence at SEQ ID NO. 38981
  misc_feature (20)..(20): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (38)..(38): n is a, c, t, g, unknown, or other
  misc_feature (39)..(39): n is a, c, t, g, unknown, or other
tggggggggttggggggggnggggttgggnnnatgggnngaacatctgtgtgttcaaactggagctccccgcggtggcggccgctctagaactagtggatcccccgggctgcaggaattcgcacgagaccattacctagaacatcctaatcgaaaaacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcggcgccgtccccggccgcagccgccgcggcggacgaggtggagcgcggcgtctacaacttcgcggcgggtcccgcgacgctccctctctccgtgctcaagcgggcgcaggcggagctggtggactaccacggctccgggatgagcatcatggagatgagccaccgcgggaaggagttcgacgccgccatcaagaaggccgagtccgacctgcgcgcgctcctcgcggggcccgacacccacgccgggctcttcctcccagggcggggccaaccacgcagtttcgcccggccgtcccgctccaaccttcttggacgggggccccctccgaacccgggccggactttcggtcggtggtcccggaatccct

SEQ ID NO: 38981 - protein, 169 aa, Zea mays
  misc_feature: Ceres CLONE 1428358-F
  misc_feature: SWISSPROT Homolog: EC 2.6.1.52 Phosphoserine transaminase
MAAAATTPHSLLLQRAAIPAAPSRASAAASPVRLPVRAARISCAAVAAPSPAAAAAADEVERGVYNFAAGPATLPLSVLKRAQAELVDYHGSGMSIMEMSHRGKEFDAAIKKAESDLRALLAGPDTHAGLFLPGRGQPRSFARPSRSNLLGRGPPPNPGRTFGRWSRNP

SEQ ID NO: 38982 - DNA, 800 bp, Zea mays
  misc_feature: Ceres CLONE 1428363-F
  misc_feature: Encodes the peptide sequence at SEQ ID NO. 38983
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (45)..(45): n is a, c, t, g, unknown, or other
  misc_feature (46)..(46): n is a, c, t, g, unknown, or other
ggggnnnnnnnnnnnnnnnaagggcgggttgggggggggcggggnnggcggcgcggccaaagggggctccccgcggtggcggccgctctagactagtggatcccccgggctgcaggaattcgcacgagaccattacctagaacatcctaatcgaaaaacatcgacccagccatctcctcaccctcgttgcaccacagaggccgccactcctttagtagcttgtgatttgtacgtcgacgagatcactggtcgggtggcggacgacgacacatggggaagggtagtgtgggtgcatcatggtgggcgtacctcctgctcgcccggggtgctggtggtcgtagcagccacaggccggggcggaggacggagtgggtcggacgggaccgcaggggggacctggcggtggtgccaaagcccggcggtccgacttgggacgtgcgggaaaaagggaacgccccgggggaagaaaggggaaaggcggaaaggcggaggggccccccatagccgggcggccggtaaaaggctggacaggggggcaaaagggacggggccaaaaggccggcgcggtgggaaccacccgatacgtgcttcccggggtatcccgtgggggggggccaagtgggccctcgcgcccgagggggccgttgcatccccccccacatagggtgcccaacccctctggggtaagacccctgcaaagggggcaaaaagagcgcgtcccccccccgcacccctcgggaattcggctacatcgtacctcgggagacccatgacacaccgggagacccgtacccacacaa

SEQ ID NO: 38983 - protein, 77 aa, Zea mays
  misc_feature: Ceres CLONE 1428363-F
MGKGSVGASWWAYLLLARGAGGRSSHRPGRRTEWVGRDRRGDLAVVPKPGGPTWDVREKGNAPGEERGKAERRRGPP

SEQ ID NO: 38984 - DNA, 660 bp, Zea mays
  misc_feature: Ceres CLONE 1428364-F
  misc_feature: Encodes the peptide sequence at SEQ ID NO. 38985
  misc_feature (532)..(532): n is a, c, t, g, unknown, or other
ctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgcagttcaacaggccccccgtggaaagcgaacangcgctctactcgagggcctcgctcgcaactgcgcttcgcctcaacttcgacctcttcaggctgctgcggccgactggcgcgacacctcttctgcggagtggctccgaacccgccgccgcgggaagagc

SEQ ID NO: 38985 - protein, 172 aa, Zea mays
  misc_feature: Ceres CLONE 1428364-F
  misc_feature: SWISSPROT Homolog: EC 1.14.11.20 Desacetoxyvindoline 4-hydroxylase
  misc_feature (130)..(130): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRSSTGPPWKANXRSTRGPRSQLRFASTSTSSGCCGRLARHLFCGVAPNPPPREE

SEQ ID NO: 38986 - DNA, 512 bp, Zea mays
  misc_feature: Ceres CLONE 1428373-F
  misc_feature (274)..(274): n is a, c, t, g, unknown, or other
  misc_feature (315)..(315): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (336)..(336): n is a, c, t, g, unknown, or other
  misc_feature (346)..(346): n is a, c, t, g, unknown, or other
  misc_feature (347)..(347): n is a, c, t, g, unknown, or other
  misc_feature (352)..(352): n is a, c, t, g, unknown, or other
  misc_feature (367)..(367): n is a, c, t, g, unknown, or other
ctccccgcggtggcggccgctctagaactagtggatcccccgggctgcaggattcgcacgagacctacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctcacgcatacaagcggcggctgcgctgccagcaccgccgcggttcatctacccgcgcggtngatctgccactccgggtcactgccactccgtgcatctcccnacgcggtccannntgcgcgcnggtcactgcnnacgcngtcatgtgccgcgcngttcatctgccgcgccacatgcactacctactcaacgccccgctcagctcatcccagcacaccatgcccgtgcacagcccatccagcccgtgccactgagggacctgcggggtggcccacccaatcctggccagtggctcagtcc

SEQ ID NO: 38987 - DNA, 669 bp, Zea mays
  misc_feature: Ceres CLONE 1428379-F
  misc_feature: Translation starting site: 173
  misc_feature (420)..(420): n is a, c, t, g, unknown, or other
  misc_feature (421)..(421): n is a, c, t, g, unknown, or other
  misc_feature (476)..(476): n is a, c, t, g, unknown, or other
  misc_feature (524)..(524): n is a, c, t, g, unknown, or other
aagctggagctccccgcggtggcggccgctctagaactagtggatcccccgggctgcaggaattcgcacgagaccattacctagaacatcctaatcgaaaacttcgctgcgccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggttgatattgttggacacattccgtctacaggagcaaccctcttttgacnnagaatcatttgtctcttacataaaaaaatacatcaagaatctcactgctgtgttngagccagagaaagcggatgagttcaaaaagggtgtcgagggtgcaccnaagtttctcctttagtagctgaaggacctttcatttttttgttgtgagagcatgaaggacgaagcgtccgtggtattcgcctatttacaggatggtgccactaatcgacattcctctatttctctcatggtctaagggagatcag

SEQ ID NO: 38988 - DNA, 828 bp, Zea mays
  misc_feature: Ceres CLONE 1428388-R
  misc_feature (821)..(821): n is a, c, t, g, unknown, or other
tatggtctcgagcgaatttgtgttgtctgggggtatacattatttggaagctgccgccaccccgatgcagctcccactttttgttaactactgaatcggactgtttcaacactagagagattgataaaagataatataaaacagaagcttttgtttctgtgtggaggattgtatgattaagcatcatcttcacctagaagggcgatgagcatctgctcatagtctcaactagtgcctttggtaatggttttctccaatggaatgctgttccttcggaggcacgcttggccaatgactttcatgtatatctcaactctcgtggacacgattcttgcgagagctccttctctctgttctcgttttgtctgatgactgatccaacaacatccacaaagtgaagctcacggcttgtcatgcattgaatggtggacctcagctgtcctcagaacttgtgcgatctatcatctgacatcaatcatgtgatcttgaggatttcctcacggcgataatcttgataacgactgaatgctggattgatctcgtgcgttgctccctcgcggacaagatccttatgaaatcatcctcattgtaaaggttgtcaatgactttctgacgattcagattagccgcgtgctccgccgaaggcatgcttacgtcctctcctgcgtagacgtttcagctaaccagatacacgtaaagctttctgacgtcaccgaaggggtgtggctatctcatcctcatcaatagacgtcttgagtccaggcgtgtgagcttcgctcgagtgtaggatctgtgtacgaagtcctagtgcagctcatccntaagcct

SEQ ID NO: 38989 - DNA, 830 bp, Zea mays
  misc_feature: Ceres CLONE 1428391-F
  misc_feature: Encodes the peptide sequence at SEQ ID NO. 38990
gtggtgggggggggggggttttctttttgtttctattctgccaattttataaagctggaactccaccgcggtggcggccgctctagactagtggatcccccgggctgcaggaattcgcacgagaccattacctagaacatcctaatcgaaaaacccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgacggcggtggccccatccggcaagaccatcctcctactcccccaccccgcctctacgacctgcacgtccctttccggttcagccccccattctaggaagtcccatccaggtccccacagaggatgaaccccggccccttccatggacgggactttgtatccactcatcggccgaaccacccgaacgttggggtgaacccgtggaggccgcccggggatccctcggagcccatgttccgtggcgtcaataacaaagcctagtccccaaaggaacacccttccccctgaagccgtcccgcccattctcttggaacccaatccccggtgtcccccacggggtcgggccggtccccctagggatttggggaccgagaacaaacttggttcatacaaggccaaaagggcgggggggcgcaaggaaccgggaaagcaaaccggttaccccttgaacggagacca

SEQ ID NO: 38990 - protein, 45 aa, Zea mays
  misc_feature: Ceres CLONE 1428391-F
MNPGPFHGRDFVSTHRPNHPNVGVNPWRPPGDPSEPMFRGVNNKA

SEQ ID NO: 38991 - DNA, 714 bp, Zea mays
  misc_feature: Ceres CLONE 1428394-F
  misc_feature: Encodes the peptide sequence at SEQ ID NO. 38992
  misc_feature (1)..(1): n is a, c, t, g, unknown, or other
  misc_feature (25)..(25): n is a, c, t, g, unknown, or other
  misc_feature (27)..(27): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
naagaactgcgtacaaaggcgggcngnangaanncnatgcccttcaaagggggtgaatcctaatcgaaaaatttttccttcctcctcccacctcttcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcagctcctgcgattgaggcagatcttcaacggtgtcttcctcaaggttaacaaggcaaccattaacatgctgcgcagggtggagccatatgttgcgtacggataccccaacctgaagagcgttagggagtttatctacaagagaggttacgggaagctgaacaagcagaggattccacttagcaacaccagtgtcatagaggaggggctcggggagcaccatatcttctggcatggaggccttggccacgagatcat

SEQ ID NO: 38992 - protein, 191 aa, Zea mays
  misc_feature: Ceres CLONE 1428394-F
  misc_feature (14)..(84): Pfam Name: Ribosomal_L30_N Pfam Description: Ribosomal L30 N-terminal domain
  misc_feature (86)..(137): Pfam Name: Ribosomal_L30 Pfam Description: Ribosomal protein L30p/L7e
MSAAEAKAAAVPESVLRKRKREEQWAADKKEKALADRKKALESRKIIFARAKQYAEEYHAQEKELVQLKREARLKGGFYVSPEAKLLFVVRIRGINAMHPKTRKILQLLRLRQIFNGVFLKVNKATINMLRRVEPYVAYGYPNLKSVREFIYKRGYGKLNKQRIPLSNTSVIEEGLGEHHIFWHGGLGHEI

SEQ ID NO: 38993 - DNA, 722 bp, Zea mays
  misc_feature: Ceres CLONE 1428397-F
  misc_feature: Encodes the peptide sequence at SEQ ID NO. 38994
  misc_feature (374)..(374): n is a, c, t, g, unknown, or other
agagctggagctccccgcggtggcggccgctctagaactagtggatcccccgggctgcaggaattcgcacgagaccattacctagaacatcctaatcgaaaaaaaagcgcttctctcgctagcgagttcggcagtagaaaccctaaaaaaaaagacaccgccctctccttcgctagcggaaccgccctcccctcgccggggtaggggtttcgggggtagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgacctctttcagctcancgagaagggatgggggggccttgtttctaagaattcatttctctttcaactggcggaaaagatttatgaaaaaaacgaaagcaaaagggaacggaaaattttttgatataaagaactccaggggatttgattagaaaagggttccttttggggggaagggtgaacccggaaaaattctcaaaggggcccttaaaacggggtttgacaaaataaaaaatccccatggctgcctatttgggaaattcggggctcctggagggtttccccttgaaggggatgagaaaacctgggcgccttgtccaaaaaacagaaaaaggggggaaaaatggggcgaaaaatttttttgcc

SEQ ID NO: 38994 - protein, 83 aa, Zea mays
  misc_feature: Ceres CLONE 1428397-F
  misc_feature (49)..(49): Xaa is any aa, unknown, or other
MDAFRKQLDVLMGANRNGDVEEVSRNYYDRDVCRLFLAGLCPHDLFQLXEKGWGGLVSKNSFLFQLAEKIYEKNESKRERKIF

SEQ ID NO: 38995 - DNA, 691 bp, Zea mays
  misc_feature: Ceres CLONE 1428400-F
  misc_feature: Translation starting site: 169
  misc_feature (381)..(381): n is a, c, t, g, unknown, or other
  misc_feature (382)..(382): n is a, c, t, g, unknown, or other
  misc_feature (427)..(427): n is a, c, t, g, unknown, or other
  misc_feature (438)..(438): n is a, c, t, g, unknown, or other
  misc_feature (456)..(456): n is a, c, t, g, unknown, or other
aaagctggagctccccgcggtggcggccgctctagaactagtggatcccccgggctgcaggaattcgcacgagaccattacctagaacatcctaatcgaaaaagacgcaccccttcctcgtttcgccgcctccgccgacaccgactgcctccctcagctgccgtcgccatgggcagaaggcctgctagatgctatcgccagatcaagaacaagccataccctaagtccaggtactgccgtggtgtccctgacccgaagataggatatacgatgtcgggatgaagaggaagggtgttgatgagttcccctactgtgtgcaccttgtctcttgggagaaggagatgtctccagtgaggcgcttgaggctgcccgcattgcctnngcacagtacatgaccaagtctgcaggaaaggatgcctcccacctnagggtccgggntcacccgttccatgtccntcgtatcaacaagaatgttttctgggctgggggctgaataggctcccaactggaaatgagggggggcctttggaaaagcccaagggcccccgggccttggggggaaaattgggcaaggccctcctttccctgggaaggaaagaaaaaaatgggttcccttccccggaaaacctctgccccccccaaaattaaatttccccgggcccccaaaaaatattttgagagaaaaaagggg

SEQ ID NO: 38996 - DNA, 706 bp, Zea mays
  misc_feature: Ceres CLONE 1428402-F
  misc_feature: Translation starting site: 289
  misc_feature (670)..(670): n is a, c, t, g, unknown, or other
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcttccttatgctccttggtctttctgcaagtgttgctaccgcaaccattttcccaaatgctcaaagctcctatagcttcccttcttccccatacctctcccagcggtgtcttcaatgtgtgaaaacccaattgttcaaccctacaggatccaacaggcaatcgcaacaggcatcttaccattatcaccccttgttccctccaacaaaccgtcagccctattacagcaagtaccttttggtccaatttggtgggacaaaacatcagggcacaacaacctacaacaacttggggtagcaaaaccttgcttgatactccccagaacactcagttttctttcctttcaacccaacggggtgacatggaacctcggcgtgctattttggaaaaacaaattcccctttctccccctctatttgggtggccacccccccaaaaaaaattttctttccttttaaccaaaatattggggggtttgtgaaacccttgggggcgcantttttttatcncccacacaaaacacactcttcaccc

SEQ ID NO: 38997 - DNA, 724 bp, Zea mays
  misc_feature: Ceres CLONE 1428421-F
  misc_feature: Encodes the peptide sequence at SEQ ID NO. 38998
  misc_feature (613)..(613): n is a, c, t, g, unknown, or other
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagaccccagagtgcatgaggcggtgccgccgccgcggactggccgtcgacatggagcaagagtacggtcgncgcagcgagagcgcgggcaagtgccgggnagagtgcgagcgccacaccgcggggactggtgggagaggcagcgctgcctgatgactgagaaacccccggaaccgaaagaag

SEQ ID NO: 38998 - protein, 159 aa, Zea mays
  misc_feature: Ceres CLONE 1428421-F
  misc_feature (143)..(143): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETPECMRRCRRRGLAVDMEQEYGRRSESAGKCRXECERHTAGTGGRGSAA

SEQ ID NO: 38999 - DNA, 741 bp, Zea mays
  misc_feature: Ceres CLONE 1428422-F
  misc_feature: Encodes the peptide sequence at SEQ ID NO. 39000
  misc_feature (405)..(405): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (547)..(547): n is a, c, t, g, unknown, or other
  misc_feature (553)..(553): n is a, c, t, g, unknown, or other
  misc_feature (741)..(741): n is a, c, t, g, unknown, or other
aagctggagctccccgcggtggcggccgctctagaactagtggatcccccgggctgcaggaattcgcacgagaccattacctagaacatcctaatcgaaaaaactagcagctagcacatcaaacaagtggcgacagacaaagatttgtgagggtgatccgcgctgagaagagatggctaagatcgccgcggcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcggcggcggcggcgttggcccgttccggtggggcaccgggctccggatgcngtgctgccagcagctccaggacgtgagccgcgagtgccgctgcgcccgccatcggagcatggtcaggggctacgaggaggccatgccgccgctgggagaaagctggtggcccatgggggcggcagagannnnnncccccccnaagggnaggaaggaggaagacagggggggctactaactaccccctgcaccggccaaggagagggaataccgctacggtcaggggtggccagcgcagaatgtttccaccgggtcgtcccgggcacaccgggcggcgggcccaggatcggccgcctgaggcttaccaaaggccggggagtccccgccggggttccn

SEQ ID NO: 39000 - protein, 136 aa, Zea mays
  misc_feature: Ceres CLONE 1428422-F
  misc_feature (78)..(78): Xaa is any aa, unknown, or other
  misc_feature (121)..(121): Xaa is any aa, unknown, or other
  misc_feature (122)..(122): Xaa is any aa, unknown, or other
  misc_feature (123)..(123): Xaa is any aa, unknown, or other
MAKIAAAAAAALCFAALVAVAVCQGEVERQRLRDLQCWQEVQESPLDACRQVLDRQLTGGGGGGGVGPFRWGTGLRMXCCQQLQDVSRECRCARHRSMVRGYEEAMPPLGESWWPMGAAEXXXPPKGRKEEDRGGY

SEQ ID NO: 39001 - DNA, 632 bp, Zea mays
  misc_feature: Ceres CLONE 1428426-F
  misc_feature: Encodes the peptide sequence at SEQ ID NO. 39002
caaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcggcggcggcggtggcgcacgcgttcccgctgtcgtggcgtgtctgtgggcgcgacatctcgggcgggcacgtgaccttgccgtgaccttcggggcctttgtgggcggaaaatcaccctgttccgggggttccgtactggggggggcacttgctgggggccacccggggggggtttccgggtcccctttttgaagggggggggaggccacggggaccctttgggttaaaggggtttttttgtttgggaagagccc

SEQ ID NO: 39002 - protein, 122 aa, Zea mays
  misc_feature: Ceres CLONE 1428426-F
MPINRIALGSHQEVYHPGALKAAFAEFISTLIFVFAGQGSGMAFSKLTGGGPTTPAGLIGGGGGARVPAVVACLWARHLGRARDLAVTFGAFVGGKSPCSGGSVLGGALAGGHPGGVSGSPF

SEQ ID NO: 39003 - DNA, 635 bp, Zea mays
  misc_feature: Ceres CLONE 1428433-F
  misc_feature: Encodes the peptide sequence at SEQ ID NO. 39004
aagctggagctccccgcggtggcggccgctctagaactagtggatcccccgggctgcaggaattcgcacgagaccattacctagaacatcctaatcgaaaagaggaggacaagggccaagggaaagaaagccaaccgccccaatctcgcgtcccgccggcggccaccaccaccaccgccatgatcagcatcctcgcgcaggagcgcctcctcggggtcgccctgggctccgtctccatgggaggtttcgtcctccaccagcgcggctcatctactgctcaatcgctgaagccgatggtcgtcctactcctccagcctggtaaattgccggcctaaaattcactgacctgctcattatggaacaaggggtgaacaaatcttgaaaatttttttaccttactcccgggaagggaccaacccctttaaaatggactgagaccccggtggagaaaattttttttacccctgatttcttattttctcgcccccgttagtttttttttaaaaaaaaaacccccgggcccattttctccagttggggtgttaaaaaaaaaaaaaaaatttttttctcccccccccccggggggggcccccaccccctccccccaaaggagggatataccccccccccccgcc

SEQ ID NO: 39004 - protein, 110 aa, Zea mays
  misc_feature: Ceres CLONE 1428433-F
AGAPRGGGRSRTSGSPGLQEFARDHYLEHPNRKEEDKGQGKESQPPQSRVPPAATTTTAMISILAQERLLGVALGSVSMGGFVLHQRGSSTAQSLKPMVVLLLQPGKLPA

SEQ ID NO: 39005 - DNA, 710 bp, Zea mays
  misc_feature: Ceres CLONE 1428435-F
  misc_feature: Encodes the peptide sequence at SEQ ID NO. 39006
  misc_feature (554)..(554): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
aaactggagctccccgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcctctgcggtgccaccagggcggcgacgccggcatggatctgctcgacctcctcctgtcaaagcacagtgtttagggtgatgaacagtgacacactgcaccnctatatctgggggtagnnannnnnanaaaaaggggtaccgacacgtaggggggcgctgtagggggcacggctgcggccataagactgtctgcagggacgtaatctaggccctcctcttccctaattctattcattgcttaggggctacaggtgaac

SEQ ID NO: 39006 - protein, 61 aa, Zea mays; identical to SEQ ID NO: 15488
  misc_feature: Ceres CLONE 1428435-F

SEQ ID NO: 39007 - DNA, 659 bp, Zea mays
  misc_feature: Ceres CLONE 1428436-F
  misc_feature: Encodes the peptide sequence at SEQ ID NO. 39008
  misc_feature (47)..(47): n is a, c, t, g, unknown, or other
  misc_feature (453)..(453): n is a, c, t, g, unknown, or other
  misc_feature (553)..(553): n is a, c, t, g, unknown, or other
  misc_feature (584)..(584): n is a, c, t, g, unknown, or other
  misc_feature (585)..(585): n is a, c, t, g, unknown, or other
ggagctccccgcggtggcggccgctctagaactagtgggatcccccngggctgcaggaattcgcacgagaccattacctagaacatcctaatcgaaaaactccgctaggttcagcagcggcaccagtcggctgagcggatctccggtgaggttgagggatcagggatggcgaacggcggcggctacgtgtgggcccttgcggcgggcttcaacgccgcgctcgccgccatctccgccaaattcatcgccactctgtggtttgcaggtgccagcctcatcattcttggcgtcttcatcctcagcaagtccagcatcgaggagaaacagaacacggattaggtggaaaagttttgaccgctagtgttagctgtaacatatacgtactccgcataagctgagccatgggatgttttgtccgtccatgtagccgaatcagagcatgactgtcattcnggctaatacatgtagtgtagcaaacatgttgtgcgagttgtcacgccagggacattgacatttcccatggtgctactggtacatcgagaatcatcgctgntatttgtatggatgggggggaaatgattccnntattttattaaatttttaatccagcgggggcaaaaaaaaaaaaaaaagctattcgaaccggccacctccgaggg

SEQ ID NO: 39008 - protein, 57 aa, Zea mays
  misc_feature: Ceres CLONE 1428436-F
MANGGGYVWALAAGFNAALAAISAKFIATLWFAGASLIILGVFILSKSSIEEKQNTD

SEQ ID NO: 39009 - DNA, 659 bp, Zea mays
  misc_feature: Ceres CLONE 1428438-F
  misc_feature: Encodes the peptide sequence at SEQ ID NO. 39010
  misc_feature (236)..(236): n is a, c, t, g, unknown, or other
  misc_feature (494)..(494): n is a, c, t, g, unknown, or other
aaactggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtcntcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctcacctacgtgggngcttctcatcctctgctccgcgggggcgtgcgccgcagggtcgtgctcctggtcccccgcccaggtccccttcctcttccccttggccgcccttgtgctcaccctggccaaccccccgaaacgaaggtccctgctccgttgggattgtctcccgttttttttggc

SEQ ID NO: 39010 - protein, 219 aa, Zea mays
  misc_feature: Ceres CLONE 1428438-F
  misc_feature (85)..(174): Pfam Name: MtN3_slv Pfam Description: MtN3/saliva family
TGAPRGGGRSRTSGSPGLQEFARDHYLEHPNRKLPPDTFLVHRSRSRSLSCCPRPTKGAGHRLFVGSKRSSRPPRPWSSADTIRTAIGVIGNGTALVLFLSPVPTFVGIWKKRAVEQYSPIPYVATLLNCMMWVLYGLPLVHPHSMLVVTINGTGMLIQLTYVGASHPLLRGGVRRRVVLLVPRPGPLPLPLGRPCAHPGQPPETKVPAPLGLSPVFFG

SEQ ID NO: 39011 - DNA, 685 bp, Zea mays
  misc_feature: Ceres CLONE 1428440-F
  misc_feature (93)..(93): n is a, c, t, g, unknown, or other
  misc_feature (658)..(658): n is a, c, t, g, unknown, or other
aagctggagctccccgcggtggcggccgctctagaactagtggatcccccgggctgcaggaattcgcacgagaccattacctagaacatcctnaatcgaaaaatcaaccatatttattgagaccaacaagcaacatagaaagtggaatccagtaccaacaatagagcaacagtggcgaccaagatattttcccctccttatgctccttgctctttctggcatgtgtggctaacgcgacaattttccctcaatgctcacaagctcctatagctttcctttcttcccccatacctttccttcaatgatagcttccgtatgtgaaaaccccggctcttcacccctatagggttccaccaagaaatcgcaggaaggaaatttccttttaaccccccttgggttcaacaattccccagcccttttttttttggccccacccattttgtaaacaaaacctttgcggggccaccacgcacgtcctcgcacagaaatttggggtgcttctctgtacaaaaaacaaaatagtttctggggaaaactttttgtcccccccactcgcaagaaaaaaaaattttttttttctttcttacaccccatttctttcttattgtgaccccgggggtcggttttttttgtccaacaaaaaacttttttccccctntcccccccgctcgtgctcccccccccc

SEQ ID NO: 39012 - DNA, 648 bp, Zea mays
  misc_feature: Ceres CLONE 1428443-F
  misc_feature (271)..(271): n is a, c, t, g, unknown, or other
  misc_feature (648)..(648): n is a, c, t, g, unknown, or other
aagctggagctccccgcggtggcggccgctctagaatagtggatcccccgggctgcaggaattcgcacgagaccattacctagaacatcctaatcaaaagactgtttgttttctaagctcgttcgccccctctcttctctccgtccaacgacggcgcgattcagatccaggcatacaggccatccttccgccgccgcggactgcgcttaatcttccttctcagcagcggggcgttcccgtcgtcctcgatcctcccctggactggatcgcnacgagatccaggcgggacctgcgtggtcccttccttttctcgatagcataatgagctccccagtggaagagtgattcgtcagggtggtatcaacttcctaggctatgggggctggatgaacaataaaatcctactggcccgggaggaggaggggtcctctcttcttcagctacaggtacagcctgggcccgccctctttgctgctcgacccaaaggtaaggaaaacccgttaaagggctccccctggaaccagtcccggttattcaaccggaaaaaccgagaaggtgtcccccctcccctccccaaaggaacaggcctccttggaaaaggccccccccttttgcctgccttcgaatgccccggttaaagggcccccn

SEQ ID NO: 39013 - DNA, 672 bp, Zea mays
  misc_feature: Ceres CLONE 1428444-F
  misc_feature: Encodes the peptide sequence at SEQ ID NO. 39014
aaagctggagctccccgcggtggcggccgctctagaactagtggatcccccgggctgcaggaattcgcacgagaccattacctagaacatcctaatcgaaaaaattaagatgatgcatatcagactagaacgagaagtagaactgtgtcaccggcgcctgtggctgcatggggacttggctcgtccatcgggttctgataccacagcaactccggtcacgccaccaagaaaaaccaccaggatgagaaacacaccaaacatgctggaagctctctaaggaacagacacgcacctccatctattcgagatggatttactgaagtactacaccatttccaccgacgtcaaccgatgtgcctgcgttttccacctcacatcaccctgtattgacgacaacaaccaagatccacataatcgactacttgatcctgacgataaggcgcacctataaatgctactgacggcgtcaaaagaacccaggctcaaagagacttgtggtgacatcatccgtatcggcgatgactactagctctaactggacagctgataagatcaagaaccactagtgtaggactgatgaatacttctgcgaccaaatatattcgcggatgcacttagtaatacgcttgctgatcatgcagcgtcgcgaattcgcacaggagcatggattgg

SEQ ID NO: 39014 - protein, 47 aa, Zea mays
  misc_feature: Ceres CLONE 1428444-F
MDLLKYYTISTDVNRCACVFHLTSPCIDDNNQDPHNRLLDPDDKAHL

SEQ ID NO: 39015 - DNA, 663 bp, Zea mays
  misc_feature: Ceres CLONE 1428449-F
  misc_feature: Encodes the peptide sequence at SEQ ID NO. 39016
  misc_feature (653)..(653): n is a, c, t, g, unknown, or other
tccccgcggtggcggccgctctataactagtggatcccccgggctgcaggaattcgcacgagaccattacctagaacatcctaatcgaaaaaacaccaccgctcgactgctctcaccgaccagcgctgcgccactcctccgccggatctccagcatgcagccctcctcctcgtcctcctccgctcacccgcccgaccatcccaactccaagcccccggccccgccggcccccgccatgggctaccccgccaaccccgcccccaacgggaaccccagcgcctacttcgccgccgcgccgcccgccgccgccgccgccaacggctccgctccggcgtccttcggcgtcgcctacccctaccccgcccctcctcaccaccatcacccgccgccgcaccaccactacccgtaccccccgcccccgccgacgcaccaccactacgcggcccacccgccgccgccgcccacctgcctgcgccgcctcctcgccgccgtcgttggcgccttccttctcctcggcgccgccaccttcatagtctggctcctcctccgcccgcgcgccccggccttctccctcacctccctggccctctcccgcgtcgcttactcccccgccaactcctcactctccgccctcttcgacgctgccctcctcngcgccaaccc

SEQ ID NO: 39016 - protein, 169 aa, Zea mays
  misc_feature: Ceres CLONE 1428449-F
  misc_feature (167)..(167): Xaa is any aa, unknown, or other
MQPSSSSSSAHPPDHPNSKPPAPPAPAMGYPANPAPNGNPSAYFAAAPPAAAAANGSAPASFGVAYPYPAPPHHHHPPPHHHYPYPPPPPTHHHYAAHPPPPPTCLRRLLAAVVGAFLLLGAATFIVWLLLRPRAPAFSLTSLALSRVAYSPANSSLSALFDAALLXAN

SEQ ID NO: 39017 - DNA, 681 bp, Zea mays
  misc_feature: Ceres CLONE 1428453-F
  misc_feature: Encodes the peptide sequence at SEQ ID NO. 39018
ctccccgcggtggcggccgctctagaactagtggatcccccgggctgcaggaattcgcacgagacagtacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactacgctactcaaccgccccggcctcagtctcatccacagccacacccatgcccgtgccaacagccgcatccaagcccgtggcagctgcagggaacctgcggcgttggcagcaccccgatcctggagcagtgcgactagctcctgaggcatcagtgcagcccgacggcgacaccctactgctcgcctcagtgccattcgttgctgcagcagtgttgcagcagctcatgcaggtggagccccaccacggtaccagcgatcttcggcttgg

SEQ ID NO: 39018 - protein, 129 aa, Zea mays
  misc_feature: Ceres CLONE 1428453-F
MRVLLVALALLALAASATSTHTSGGCGCQPPPPVHLPPPVHLPPPVHLPPPVHLPPPVHLPPPVHLPPPVHVPPPVHLPPPPCHYATQPPRPQSHPQPHPCPCQQPHPSPWQLQGTCGVGSTPILEQCD

SEQ ID NO: 39019 - DNA, 682 bp, Zea mays
  misc_feature: Ceres CLONE 1428460-F
  misc_feature (370)..(370): n is a, c, t, g, unknown, or other
  misc_feature (379)..(379): n is a, c, t, g, unknown, or other
  misc_feature (400)..(400): n is a, c, t, g, unknown, or other
  misc_feature (467)..(467): n is a, c, t, g, unknown, or other
aagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatgggtgcggcagctctgctgggcttggccctgggcgtgtccaccgccgaagcgaggacatcaagaccaccacaacngaaaagaangacgacgcggtggtgcagccncagaacttcccgcccttcgaccgcctcggcggcggcccgtccccggcgttccgcggccctcccggcngcagcatccctggcagcagcattcccgggttcagcatgcccgggagcggcagcagcctacccgggttcagcttgccccggaaacggaagatgccccctcttcgggggcggctccccggggtttcagcggtttcggggggatccccgggtccccccacggccgggttccgtccccaaaaacgccaaaaagccctgaaacccaacaagcgtggtgag

SEQ ID NO: 39020 - DNA, 600 bp, Zea mays
  misc_feature: Ceres CLONE 1428465-F
  misc_feature: Encodes the peptide sequence at SEQ ID NO. 39021
  misc_feature (304)..(304): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcnttccagtatggtgaaaaaccccggttttttttaaaaccccctataggggggcccccccaacaaaaaaaaattctccccgaagaaaaaaaaaaannnttttttttttttcttgttaaaaacaccccccccctttttggggggggggtggaaaaaaaaaaggggggggagcgcgccccccccccccttgttgtgtgaaaaaaaaaaagaggtgggggaaccttcttccttccccctctgcgaaaagaaaaaaaacttttcttttttcccccccaccccctctttttatagtggggggg

SEQ ID NO: 39021 - protein, 109 aa, Zea mays
  misc_feature: Ceres CLONE 1428465-F
  misc_feature (77)..(77): Xaa is any aa, unknown, or other
MATKIFSLLMLLALSACVANATIFPQCSQAPIASLLPPYLPSMIAFQYGEKPRFFLKPPIGGPPQQKKILPEEKKKXFFFFLVKNTPPLFGGGVEKKKGGERAPPPLVV

SEQ ID NO: 39022 - DNA, 725 bp, Zea mays
  misc_feature: Ceres CLONE 1428467-F
  misc_feature: Encodes the peptide sequence at SEQ ID NO. 39023
  misc_feature (407)..(407): n is a, c, t, g, unknown, or other
  misc_feature (409)..(409): n is a, c, t, g, unknown, or other
  misc_feature (410)..(410): n is a, c, t, g, unknown, or other
aagctggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctactcgccgatcgatacgatggccgtcttctccgacctccacaccgccgacggcctcaagtccctcgaggctcacctcgccggcaaaacctatgtgtctggtgacgccattagtaaggatgacattaaggtcttcgccgcggtgccctcgaagcctggcgctgagtttcctaatgccgcccgctggtacgagaccgtctgtgcggggggggggggggggatcccctggtaaggntnnccccccccgctcggctggggggatacgcttcctgccgggacgctcctccctccgcgatcaagctgaaggatcgatgacgaccccttgatctttttctgggtgatgaatcttcagcacgaacaacaaggggcggcttaaggaagcgtgggcgcgcccctgccaagggcgccgtttccaaaaaagcagagaagggaggaaaaatccttcgcgccttttatggatgcggcgaccttccggagcgcagcgaggctggttatcgcgcctcgctcgagacgctgccgtttgtcccccatccccccacgagcgcggtccccc

SEQ ID NO: 39023 - protein, 70 aa, Zea mays
  misc_feature: Ceres CLONE 1428467-F
MAVFSDLHTADGLKSLEAHLAGKTYVSGDAISKDDIKVFAAVPSKPGAEFPNAARWYETVCAGGGGGIPW

SEQ ID NO: 39024 - DNA, 665 bp, Zea mays
  misc_feature: Ceres CLONE 1428468-F
  misc_feature: Translation starting site: 214
  misc_feature: SWISSPROT Homolog: EC 1.11.1.7 Peroxidase
  misc_feature (312)..(312): n is a, c, t, g, unknown, or other
  misc_feature (352)..(352): n is a, c, t, g, unknown, or other
  misc_feature (444)..(444): n is a, c, t, g, unknown, or other
  misc_feature (445)..(445): n is a, c, t, g, unknown, or other
  misc_feature (549)..(549): n is a, c, t, g, unknown, or other
  misc_feature (557)..(557): n is a, c, t, g, unknown, or other
  misc_feature (594)..(594): n is a, c, t, g, unknown, or other
aagctggagctccccgcggtggcggccgctctagaactagtggatcccccgggctgcaggaattcgcacgagaccattacctagaacatcctaatcgaaaatcgcgccagagccacgcacgctagtgtcagtggcacgcaggcagccgcgcgcaccgaggggagaccagagctagcggcgaggccaagggcaagggcaagggcgcggacggcaatggcgagagctggaggcggcggtccgttctttcccgtccgcggcgcggcgctggtggtcgtgctgctaggcatcgtccgcggcgccgcgaaggcgcanctgccgctgaactactacgggagctcgtgccccagcgcgnagtccacggtgcgctccgtcatctcgcagcgcctccagcagagcttcgccgtggggcccggcacgctcccgctcttcttcacgactgcttcnntcagggatgcgacgcgtcggtgatgctgatggcgcccaacggggacgacaagagccacagcggcgcggaccccacgctgtccccggacgccgtggaccccatcnacaaagcnaaagcggccgttgaggccctcccccgggtgccccggnaaggtctcgtgcgcggacatccctgccatggccccacgtgacctcctctccctgctgggcggggccagcta

SEQ ID NO: 39025 - DNA, 654 bp, Zea mays
  misc_feature: Ceres CLONE 1428472-F
  misc_feature: Encodes the peptide sequence at SEQ ID NO. 39026
  misc_feature (558)..(558): n is a, c, t, g, unknown, or other
ggagctccccgcggtggcggccgctctagaactagtggatcccccgggctgcaggaattcgcacgagaccattacctagaacatcctaatcgaaaaaatgtcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggtaaaacctcccccgcgctccggccatgcgccggcgccgcagccgcttgccatcgagcagccatggctcacgatcgacgctctgtgtgtctgcgtgcgtggtttgcaggcgacggaggggatgaacgtgaaggaggagtgccagcgctggttcatggagatgaagtggaagaaggtgcaccgcttcgtggtgtacaagatcgacaagcggtcgcgcgccgtgctgggtggacagggtggcggccccggggaaggggtacgagagctcgtgggccgcgctgcccgggcgacgactggccgctaccnccggtcttcgactttcgaaattccgtcccccggcaaaaaattggccaaaaaaagcaagaattttttttcctcccccccgggggccccggggggggg

SEQ ID NO: 39026 - protein, 140 aa, Zea mays
  misc_feature: Ceres CLONE 1428472-F
  misc_feature (109)..(109): Xaa is any aa, unknown, or other
MAMAYKMVKPPPRSGHAPAPQPLAIEQPWLTIDALCVCVRGLQATEGMNVKEECQRWFMEMKWKKVHRFVVYKIDKRSRAVLGGQGGGPGEGVRELVGRAARATTGRYXRSSTFEIPSPGKKLAKKSKNFFSSPPGAPGG

SEQ ID NO: 39027 - DNA, 656 bp, Zea mays
  misc_feature: Ceres CLONE 1428475-F
  misc_feature: Translation starting site: 196
  misc_feature (334)..(334): n is a, c, t, g, unknown, or other
  misc_feature (374)..(374): n is a, c, t, g, unknown, or other
  misc_feature (397)..(397): n is a, c, t, g, unknown, or other
  misc_feature (398)..(398): n is a, c, t, g, unknown, or other
  misc_feature (408)..(408): n is a, c, t, g, unknown, or other
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccnggtggtcgtgggtggcggcgccgtcgtcgtccccaccgcnccgaatggggccggacggtctcnnttcttgttcnggggaagaagccgttgtggtttaccagaacaacggcaaccctctgcccagcggcatcccggcctacaccgtgagatcatcaacgtctgcngcggaaggtgcaccgtgtacgacgtgcacgtcttctgcggcgactttccctccacggagctcgtcgacccggccaagtttcagcgcgtcgccttcaacactgcttcgtcaggggcggcccccctttggacccagcgagaccgtctccttcagtactcc

SEQ ID NO: 39028 - DNA, 720 bp, Zea mays
  misc_feature: Ceres CLONE 1428481-F
  misc_feature: Encodes the peptide sequence at SEQ ID NO. 39029
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (720)..(720): n is a, c, t, g, unknown, or other
nnnnnnnnnnnnnnnnnnnnnnnnnnnaaaaccccatttaancnnntnnnnntgggttnnnnnnttcaaagctggagctccaccgcggtggcggccgctctagaactagtggatcccccgggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcgccctcgaggactcgaagacgcttctcttcggcgagaagccggccaccgtctttggcatcaggaaccccgaggagatcccgtggggtgaggctggtgctgagtatgtcgtggagtccaccggtgtcttcactgacaaggacaaggctgctgcacatcctggaagggtggtggcaaagaagggttgttatctcctgccccaaggcaaaggatgcaccccagggttggttgttgggtgtaaatggaggacaaataacaccttccgagtgtttaaccattgtn

SEQ ID NO: 39029 - protein, 154 aa, Zea mays
  misc_feature: Ceres CLONE 1428481-F
  misc_feature (4)..(132): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDIALEDSKTLLFGEKPATVFGIRNPEEIPWGEAGAEYVVESTGVFTDKDKAAAHPGRVVAKKGCYLLPQGKGCTPGLVVGCKWRTNNTFRVFNHC

SEQ ID NO: 39030 - DNA, 701 bp, Zea mays
  misc_feature: Ceres CLONE 1428482-F
  misc_feature: Encodes the peptide sequence at SEQ ID NO. 39031
  misc_feature (429)..(429): n is a, c, t, g, unknown, or other
  misc_feature (434)..(434): n is a, c, t, g, unknown, or other
  misc_feature (435)..(435): n is a, c, t, g, unknown, or other
  misc_feature (449)..(449): n is a, c, t, g, unknown, or other
aagctggagctccccgcggtggcggccgctctagaactagtggatcccccgggctgcaggaattcgcacgagaccattacctagaacatcctaatcgaaaagattatatcgaaaatctggacggcggcggactcgattgtagcagcagccgccgggaacaagatggcggcggcgttgtcgcagctggacgacgagatcgtccgcggcatggccatcggcgctgtcttcaccgactatgccgggaagataaactgcctcgatttccaccgcaaggaagatctcctcgtcacttccagcgaggacgactccatccgcatgtacaacatcaccagcgcgacgttgttaaagactacatatcacaggaaacatggtgctgaccgtgtctgttttagtcatcatccaagttctatcttatgctcttcacgatancaccnntagagtcttgcagnaattccccttcctttaccggcattggatgacacccgtggtttaaataccttcaagggaacccaaagcaagggggccttttcctattattatatcccccccccccaaaaaaacctttttttgtgggggggacctttttttccacccgggggaaaaaatagggggattccccccccaaaaaatttgtgggggggagaaaaaaaggggggcgggggaggaccaacctctcccccaaaaaaaaaaaaggaaaaaaa

SEQ ID NO: 39031 - protein, 90 aa, Zea mays
  misc_feature: Ceres CLONE 1428482-F
  misc_feature (89)..(89): Xaa is any aa, unknown, or other
MAAALSQLDDEIVRGMAIGAVFTDYAGKINCLDFHRKEDLLVTSSEDDSIRMYNITSATLLKTTYHRKHGADRVCFSHHPSSILCSSRXH

SEQ ID NO: 39032 - DNA, 661 bp, Zea mays
  misc_feature: Ceres CLONE 1428484-F
  misc_feature: SWISSPROT Homolog: EC 3.4.21.92 Endopeptidase Clp
  misc_feature (383)..(383): n is a, c, t, g, unknown, or other
tggagctccccgcggtggcggccgctttagaactagtggatcccccgggctgcaggaattcgcacgagaccattacctagaacatcctaatcgaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgccctcgcgcttgcgcttgggcccctcgcagcgacggcagcaagggcactcgtcagcctcaagccttgccgctcactggcacacaagctcctctgtgggggcgcgagtcngatgccccggggggttgttcccgcccccggcatgtcatgggcctcctcctccgggagccgatagtcctcctcggcaacagatcgaggacttcctcgcggacgccgtcgtcagccagctcctcctccttgacgccatcgacccggactctgacatccgcctcttcgtcaactcaccaggggggatcccttagcgcaacaatgggcatctatgatgtaatgcaaccttggaaggggcaaaacgtccccctattggaatgggcatagctggattcacagct

SEQ ID NO: 39033 - DNA, 694 bp, Zea mays
  misc_feature: Ceres CLONE 1428491-F
  misc_feature: Encodes the peptide sequence at SEQ ID NO. 39034
gctctagaactagtggatcccccgggctgcaggaattcgcacgagaccattacctagaacatcctaatcgaaaagccaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctagggcgggtgggcgctggggcaggcgaaacaccagaagctggcccgcgaccgggctgcggttccccccgcgtggtgcgccggcgagcaacaagtcgtggcccggggataaactacccccctcttacgtgaaaccccgccaaaccccgcccgggccgcaccggggccccctacgtcccccctccggtgaaacaaaaaagggcctgggaacccgcaaccccgccagggttcgcctctcttttaaacccggggggccccgccgccccccccgaaaaacccaaagcgaacaccggggggggggcccaaaacccaccccccaacaaatttttccccccccataattaacgggggcgcagggctaaaccttttaatatttgggtctcccacaaatataaaaca

SEQ ID NO: 39034 - protein, 95 aa, Zea mays
  misc_feature: Ceres CLONE 1428491-F
MATHRHCLPLLLVAAALALAAVPARAALGGGRGPLLGGWNPIPDVSDSHIQELGRVGAGAGETPEAGPRPGCGSPRVVRRRATSRGPGINYPPLT

SEQ ID NO: 39035 - DNA, 900 bp, Zea mays
  misc_feature: Ceres CLONE 1428494-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (22)..(22): n is a, c, t, g, unknown, or other
  misc_feature (45)..(45): n is a, c, t, g, unknown, or other
  misc_feature (900)..(900): n is a, c, t, g, unknown, or other
nnnnnnnncccccccccccccncctctacccacaccctacccggngttggttctttcaatactggagctccccgcggtggcggccgctctagaactagtggatcccccgggctgcaggaattcgcacgagaccattacctagaacatcctaatcgaaaaccgaggaaggaaccctagcctagccttgctccgaccggtcgccgcggcgactgcgacgatgatggactgcgctggaggccgagaccccgtggaggacttcctcctcggcggcgcccggcgacgacggagatctcgtcgccgtcttctgcgacgacggaggacttggggatttgaggggatccatgggagatgcttgggggattttgagcaatcctaatttgggggaaaaagggggtagagatgaaaccatggttcttctggggcccaaaccttcccaagagctttgttcggggaataaaaaatgaagggaaggggacaaagcctggaaatggaccaggggttccctggggaaactaaccctccccaggtttaataaagctccccggggttaaggggaaagcccaaaaggcttctgatatgaagagggtaaacatattattttcggtggggggggagttggcgcaccccccgccggtagtggggtgggggacacacaccgttttagaaagggggcggagggcccgaaaaaaaagctcttttaccgggaataccccaaaatagaaacaaccccggccggcgggaaaaaattttctcgggggcttttcgggaggggaggagagaaacaaacccccgccctccgcgtgggaagaagagagggtggagccttaacacggaataacaacaggttatggcggggggaaccccctgtgctcccaacctctttgagggtgggcgcccccn

SEQ ID NO: 39036 - DNA, 552 bp, Zea mays
  misc_feature: Ceres CLONE 1428498-F
  misc_feature: Encodes the peptide sequence at SEQ ID NO. 39037
tcacccgcggtggcggccgctctagaactagtggatcccccgggctgcaggaattcgcacgagaccattacctagaacatcctaatcgaaaaacaaaacacatccatcctcgctagctcgctctctcttgcaactccagtgcttctcactgccactgccagcaggtcgagctgctccgcaagtctgctttgctgctgcacctgcaagtctgcaaccgcgcacagagatgtcgacgactgtgagccgtgcgtccctcgacagaaactcgccctcgcagcgctgctccgagagcgaccctcgcggagcaaggggcagcgtgcgactatgctcgcgatcccacctggcagctgcgatctgcatgggcaggccacatcacccaccgccagggcttatgttccccgggctgggaggcccactccccccccaaaaaaaaccttccctgggaggcccctttttaacaagccctaaccccaaaaacctctttcagggacccgcctccccacccgttttttttgggcgggaaaaaaaccccctaaaaaaaaaaacacctcc

SEQ ID NO: 39037 - protein, 47 aa, Zea mays
  misc_feature: Ceres CLONE 1428498-F
MLAIPPGSCDLHGQATSPTARAYVPRAGRPTPPPKKTFPGRPLFNKP

SEQ ID NO: 39038 - DNA, 741 bp, Zea mays
  misc_feature: Ceres CLONE 1428505-F
ggagctccccgcggtggcggccgctctataactagtggatcccccgggctgcaggaattcgcacgagaccattacctagaacatcctaatcggaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctaccaccaagtactactgcaccgtctgccggagcgcgccctcttcggccgccgcgagtggtacttcttcacgccgcgggaccgcaagtaccccaacggctcccgccccaaccgcgccgccgggtcgggctactggaaggccacggacgcggacaacccccatggagcaccggggtccgttcacccttgatgtaaagacaatgattttgctgctgtaacaagatggatgccaccaccccccaagacctccaaggctagggtacaatgagatcatccagggaggtgtcttccctaccttgaggaaggttggggtacaacccctgacaaaatcccctttc

SEQ ID NO: 39039 - DNA, 727 bp, Zea mays
  misc_feature: Ceres CLONE 1428507-F
  misc_feature: Encodes the peptide sequence at SEQ ID NO. 39040
ggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggtgatggaactacaactgcctctgttctcgctagggagatcatcaaattgggcatgttgagcattacttcaggggcaaatccagtgtccgttaaagaaggcattgataagactgttcagaaattggtggaggaacttgagaagaaatcaaagccggtcaagggtagtggggatataaaa

SEQ ID NO: 39040 - protein, 190 aa, Zea mays
  misc_feature: Ceres CLONE 1428507-F
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMLSITSGANPVSVKEGIDKTVQKLVEELEKKSKPVKGSGDIK

SEQ ID NO: 39041 - DNA, 632 bp, Zea mays
  misc_feature: Ceres CLONE 1428510-F
  misc_feature: Encodes the peptide sequence at SEQ ID NO. 39042
  misc_feature (274)..(274): n is a, c, t, g, unknown, or other
ccgctctagaactagtggatcccccgggctgcaggaattcgcacgagaccattacctagaacatcctaatcgaaaagtctacgatgccgttgcgcacctcttctctctcgccgccccgagacccccacgcttccctctccgcccccgaactgtggcgcctccccccgccgccgcagcgatgccactcgcggcagagcccgacgacgctcatgaggaaagggagaatcagcagctgctaattacgacgaaaggaggccccgggctgagggactgntggtggggagctactgccacgatgtgctaatccggggcggggccataatgggggaaaccctcgggggggctgcggctttgtgttcaaggggttcaaaccctttcccccagggggcccccttcaagaaaaacccccctttgcctttgggcccagggggggtaaaatttttttaaccccggcccccggtccccgggggaaccccccttgttttttttgccccaaaacctctttttccccccatttttggaaaaacccccccttggggacccccccccaaagggaaacccgggggggggggccccttaacacaatttatttccccgagaatttttaaagaggggttttttttaaaggggtt

SEQ ID NO: 39042 - protein, 41 aa, Zea mays
  misc_feature: Ceres CLONE 1428510-F
MGETLGGAAALCSRGSNPFPQGAPFKKNPPLPLGPGGVKFF

SEQ ID NO: 39043 - DNA, 681 bp, Zea mays
  misc_feature: Ceres CLONE 1428517-F
  misc_feature (399)..(399): n is a, c, t, g, unknown, or other
aagctggagctccccgcggtggcggccgctctagaactagtggatcccccgggctgcaggaattcgcacgagaccattacctagaacatcctaatcgaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaatagggaagtatacagagtggtttaatgatgtttctggtcatgagatatcgggtacatgtgacgatgcacttaaacttctctgcagtgctttcggatgtcaaatagaagagataacattaccagaactggaagagatgcgactggctcatgttntctcaattggctcaaaaccttccggggactggaatcctctttccaagcaggaagaaaaactgattttccctgggaaccccaacaaagttgggcctttttgggtctttccctgcaactgaatttggggctttcccaaaggttgggggggagggaatatcgttttcccatgggaaactttttaaaaaggtgaatggtctaaaccccccccaaaaactggggttttcggtcccaaaaaaaacccccccaggcttctttaaagccggggaaattctaatttttttt

SEQ ID NO: 39044 - DNA, 651 bp, Zea mays
  misc_feature: Ceres CLONE 1428519-F
  misc_feature: Encodes the peptide sequence at SEQ ID NO. 39045
ctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgccccgccctgggccaagccagagcctgcctctgttctgccaggtggccgccgccgtgacggccgcccgggcaggggaagaaaaagctgctgggtggtggccggccggctggaacccggaaacctgggcgcccaacggaccccgt

SEQ ID NO: 39045 - protein, 152 aa, Zea mays
  misc_feature: Ceres CLONE 1428519-F
  misc_feature (3)..(50): Pfam Name: F-box Pfam Description: F-box domain
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPRPGPSQSLPLFCQVAAAVTAARAGEEKAAGWWPAGWNPETWAPNGPR

SEQ ID NO: 39046 - DNA, 777 bp, Zea mays
  misc_feature: Ceres CLONE 1428522-F
  misc_feature (1)..(1): n is a, c, t, g, unknown, or other
naagagctggagctccccgcggtggcggccgctctttttctagtggatcccccgggctgcaggaattcgcacgagaccattacctagaacatcctaatcgaaaaatcaccaccactgggtctttagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccgggccacctgccgccgccggtccacctgccaccgcccggtgcggggggcgccgccggttcatgcagccgccgcccaccatgccgctacgctgctcaggcctcccgcggcctcagccctcatccccagggcgcagcgcgatggccggtgccagacagccgccatgccgaggcccgtggccaggcgtccgcggaaccctggcgagcctcggcagacgagcccctatcctgcgagcccggggcgtgggagttgcctggaggccctgcgcggaccagccgtacggcgcacgccctgtgcggcgtcggcctccggacccacgtccgtccccagcacgcccccggccacgcggcccccctgcgggcacgcggacgccctgtacgagccggagccccgagccgcatactacgacgtgcgggccctgcgacggccagcccg

SEQ ID NO: 39047 - DNA, 660 bp, Zea mays
  misc_feature: Ceres CLONE 1428524-F
  misc_feature (438)..(438): n is a, c, t, g, unknown, or other
ggagctccccgcggtggcggccgctctagaactagtggatcccccgggctgcaggaattcgcacgagaccattacctagaacatcctaatcgaaaaaattccacactctctctctccatcaattccttgcttgattgcttggcatggttgcgcggtcaatgtccaacccgtccccaattcgaatcctcttcttcctctgtgctgctgctgctcacagacccaggccaagtcgtctcagtcctcttctaccaccaagctcccgtctcttcccctcctggtctcagcgactccatcctctccctctccagatccccgcccgtgacgccgccggctgttacctctccggctcatcgtcctcaggcccaggtaattcatcaattgccgtgcttttatcgtttccctaccgatttacggtacagtacttgctccactccgtcngccgtgctgctgcggccagtgattgattcgtcgggcaaaagaccgtctttttttctccatccaatcatccatcccatcatccatccttatgagcgattctagcttcttggataaaatcattgggccgatgagcaccgtggcctcccgaatttgcagggcttgatccgcgatccgcctatttccatccggcgcttactcggggtcccgtcacctgcgggtttg

SEQ ID NO: 39048 - DNA, 665 bp, Zea mays
  misc_feature: Ceres CLONE 1428526-F
  misc_feature: Encodes the peptide sequence at SEQ ID NO. 39049
  misc_feature (416)..(416): n is a, c, t, g, unknown, or other
  misc_feature (635)..(635): n is a, c, t, g, unknown, or other
  misc_feature (636)..(636): n is a, c, t, g, unknown, or other
ggagctccccgcggtggcggccgctctagaactagtggatcccccgggctgcaggaattcgcacgagaccattacctagaacatcctaatcgaaaatatataataacatgctcgcaaaggagggtacagatggtgaagaagaagccaggagagcgtacaaggctgctagggaggaatcagaccatgctgcagaggcagcttgtgggagaaaggtctcttcagctttgattgatagggttgatgctatgcttcaaaagttagaaaaggagattgatgatgttgatgctcgaatttgcatccctggcagctgctggatagggactgccatgggcaggtgactcctgaaggagtagctgcagctgccaatttatctcaaagacgccctagggagcaaaaggcttccaggagcttatcanccaattctttctaaaaaaccaccgaagggaaatttctcctttgggaaaaaaattttttggaaaacttgggggcccccccccaaggggggggaaaaaaccccccccgcccttttgaaaaaaaaaccccccccccccttttttttttttttaaaaaaaaacccccccccctctttttttttttttttttaaaaaaaaagaaaagcgcggggggggcccggnntttttttttttttttttataaatagagga

SEQ ID NO: 39049 - protein, 76 aa, Zea mays
  misc_feature: Ceres CLONE 1428526-F
MLAKEGTDGEEEARRAYKAAREESDHAAEAACGRKVSSALIDRVDAMLQKLEKEIDDVDARICIPGSCWIGTAMGR

SEQ ID NO: 39050 - DNA, 650 bp, Zea mays
  misc_feature: Ceres CLONE 1428528-F
  misc_feature: Encodes the peptide sequence at SEQ ID NO. 39051
aaagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggccccagtgcctgcggccgcacgagggccagccgtgggagacccaggagtgcatgaggcggtgcccgccgccgcggactgggcgtccaacatggaacaaagattacggtccccggcaaccaagagcgcgggcaaattcccgggaagag

SEQ ID NO: 39051 - protein, 146 aa, Zea mays
  misc_feature: Ceres CLONE 1428528-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRPQCLRPHEGQPWETQECMRRCPPPRTGRPTWNKDYGPRQPRARANSREE

SEQ ID NO: 39052 - DNA, 625 bp, Zea mays
  misc_feature: Ceres CLONE 1428529-F
  misc_feature: Encodes the peptide sequence at SEQ ID NO. 39053
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtcgggcgccctgggggctcggggggcctgtcctcccgcttaaggggcccccccccaaaaagggggggggggaggggttttcccccccccccccccaaaaatg

SEQ ID NO: 39053 - protein, 119 aa, Zea mays
  misc_feature: Ceres CLONE 1428529-F
  misc_feature (44)..(120): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSGALGARGACPPA

SEQ ID NO: 39054 - DNA, 813 bp, Zea mays
  misc_feature: Ceres CLONE 1428532-F
  misc_feature (627)..(627): n is a, c, t, g, unknown, or other
  misc_feature (740)..(740): n is a, c, t, g, unknown, or other
  misc_feature (741)..(741): n is a, c, t, g, unknown, or other
aagctggagctccccgcggtggcggccgctctagaactagtggatcccccgggctgcaggaattcgcacgagaccattacctagaacatcctaatcgaaaagttgaattaacacatacagaggagagtcacaacacaaatccgaagaagccggagagtgaaaaaaaatggcagcgacgactctttccatcgcaaccacaatccgctcctcctctcacctcactcccgcttctccccatgtcttcccttcccgaccaaacacaaccgcatttccctttcgccttggttcatcttctccgacactaacccaccgtgcaacccacctccgtcccatatccgccgtcgaggccccgggagaaaatcgagaagatcggatccgaaatctcgcccctcactctcaaagaagcactcatcctcttcgacttacctccgggacaagtttgggcgtcttcggccgctcatctgtagctcccggcggcatcggccctgtggtccgcctctccggaagacccttggtcctgttgtcgattgtccggctgtttctacgcgagcataaccccagtctccattctcggtccatcaacccaaagccccgaattcatcggcgggctgtcccgggggggggaanacaccctctatgctctctccacccacctttgctcccttaattgctcgcgtaggttcccttctcttaaggatttttccaaataattcacgccaggtaccctcccccacacgttnnccaacgacgaatactccgttcctccgccgcgtgcgggttatcttactaggcaaggtgatcgtggtgcccctt

SEQ ID NO: 39055 - DNA, 656 bp, Zea mays
  misc_feature: Ceres CLONE 1428538-F
  misc_feature (184)..(184): n is a, c, t, g, unknown, or other
  misc_feature (428)..(428): n is a, c, t, g, unknown, or other
tggagctccccgcggtggcggccgctctagaactagtggatcccccgggctgcaggaattcgcacgagaccattacctagaacatcctaatcgaaaaaaaaacaggcaatgggcaacgcataggcatagcttgggctcgcacggtgtcgctggctcccctccccttccctccccactgttacantccagcgagctgttcacggccgtgccgagctcagtgaggcagcgtttgcagtccgggacgaggggagcggcgggcgacatggggaggggccgcagcgagataagcggatcgagaaccccacgcagcggcagtccaccttctacaagcgcagggacggcctcttcaagaaggctagggagctctccgttctgtgcgacgtggacctgctgctgctcctcttctcacctccgggcagctctaacantacttctcgcccacggtcccctccgtaaagaacctggtcgagaggtacgaagccaccacccaccccaagggctggaccaactcccccaagaaccgccccccggagtctagaaaaagccaaacaaaatttccaaccttaatgaaaaaaagaccttccgggtcttgaacgggggaccaaaggggaaaaaaaaaccgggcccctcccctggaagctttttgaaaacaaccc

SEQ ID NO: 39056 - DNA, 651 bp, Zea mays
  misc_feature: Ceres CLONE 1428539-F
  misc_feature: Encodes the peptide sequence at SEQ ID NO. 39057
aaagctggagctccccgcggtggcggccgctctagaactagtggatcccccgggctgcaggaattcgcacgagaccattgcctagaacatcctaatcgaaaaattttccgtacgccgtacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgccactcgccggggtccgggtcgagtcgctcgacctgttccagtgccccgtcaccaaggtcaaggggtacagggatgaggtcttcgcgctgattcccagcctcaagta

SEQ ID NO: 39057 - protein, 157 aa, Zea mays
  misc_feature: Ceres CLONE 1428539-F
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLGNNRFAEVQELAPLAGVRVESLDLFQCPVTKVKGYRDEVFALIPSLK

SEQ ID NO: 39058 - DNA, 640 bp, Zea mays
  misc_feature: Ceres CLONE 1428549-F
  misc_feature (293)..(293): n is a, c, t, g, unknown, or other
  misc_feature (298)..(298): n is a, c, t, g, unknown, or other
  misc_feature (425)..(425): n is a, c, t, g, unknown, or other
aaagctggagctccccgcggtggcggccgctctagaactagtggatcccccgggctgcaggaattcgcacgagaccattacctagaacatcctaatcgaaaaattttgttgagacctagatacgggcccttgctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacgatggcggaggacttgnttttngacacgggcgatcggagactgggtcctgatcccgctctccgtggtatggtcctcatcggcgtgctcgcctactttgtctccaagctgatgggctccccggggacctctccgtctccccaccccaaanttggttaaggaagggcagggtggtcctccgggccgaaggcccttgaagaaccacccacaggttcttccccggccaaggcttttcaaggcccccaagggttttttcccccccccggaggaaaatgggtttcctttcttgtcccaaaagaaaaaccccaagaaggcctcggcgcccctttttttctaaccaaaacggggccctgggcttataaaaaa

SEQ ID NO: 39059 - DNA, 687 bp, Zea mays
  misc_feature: Ceres CLONE 1428552-F
  misc_feature: Encodes the peptide sequence at SEQ ID NO. 39060
  misc_feature (499)..(499): n is a, c, t, g, unknown, or other
  misc_feature (535)..(535): n is a, c, t, g, unknown, or other
  misc_feature (588)..(588): n is a, c, t, g, unknown, or other
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctnggtgtcgccatcctggccggcgtggtgggcgccgcntccaagctggcgggcgtgcaccacgtgcgcgcctggcgccacgacagcctggncaccaacgcggcgtcgtcgctcatcgcctgggccatcacggcgcctcgccttcggcctgcctgcaaggaaatcacatcggcggaaaccgcggctggcgc

SEQ ID NO: 39060 - protein, 116 aa, Zea mays
  misc_feature: Ceres CLONE 1428552-F
  misc_feature (14)..(116): Pfam Name: AWPM-19 Pfam Description: AWPM-19-like family
  misc_feature (84)..(84): Xaa is any aa, unknown, or other
MAGIGRNMVAPLLVLNLIMYIIVIGFASWNLNHFINGQTNYPGVAGNGATFYFLGVAILAGVVGAASKLAGVHHVRAWRHDSLXTNAASSLIAWAITAPRLRPACKEITSAETAAG

SEQ ID NO: 39061 - DNA, 665 bp, Zea mays
  misc_feature: Ceres CLONE 1428553-F
  misc_feature: Encodes the peptide sequence at SEQ ID NO. 39062
  misc_feature (220)..(220): n is a, c, t, g, unknown, or other
  misc_feature (333)..(333): n is a, c, t, g, unknown, or other
  misc_feature (372)..(372): n is a, c, t, g, unknown, or other
aaagctggagctccccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgnaatcacacgcgcgccacccgcgatgacgccggcggcggcaatctccggctccagcagccacgtcgtcgtctcctccgccccgctcaggcagccgttcacgctccctccgcgcnacgtttgccaaatcgcgccgccgcctcggccgtgacccngcgcggggtcgcggtcgccgccgtgtcaagccccgttgtgtccccgccccggggaaggatgccaacaggctcctaggatttccttcaatcattgattttgaaagggtacaataatgaggatcttaatccaccctcgaggttaaggatttgaaaagtctggaaacaagaccttccacccttcaaagggaaaaaagggccattatttttccaacccatcaataaggaccgtggttcatttagaaaccggatttttttttcttggggggaatgctttttttttggggccaaaaaaa

SEQ ID NO: 39062 - protein, 41 aa, Zea mays
  misc_feature: Ceres CLONE 1428553-F
  misc_feature (31)..(31): Xaa is any aa, unknown, or other
MTPAAAISGSSSHVVVSSAPLRQPFTLPPRXVCQIAPPPRP

SEQ ID NO: 39063 - DNA, 648 bp, Zea mays
  misc_feature: Ceres CLONE 1428556-F
  misc_feature: Encodes the peptide sequence at SEQ ID NO. 39064
aaaactggagctccccgcggtggcggccgctctagaactagtggatcccccgggctgcaggaattcgcacgagaccattacctagaacatcctaatcgaaaagtgccacagtccctcccctcttccagtctcgccgccaattagtactcaccccctcccttgcatccgctcccctcccccctcctctcttccccccccgacctcagcgccgaggcatgctgttgccgtgagtgagcaagggatctttccggcgatcttggaggcggcgagcctggtgccgcatgctggctgtccggacggccggaggctagctagctctcgcctctcgaccgagaagtgaagtgaagtgaagcgagatggacctggtgccgcacccggacagcccgcactccgacaacagcggcggcggcggcggctcggcgtccggggcgctgtcgccggaggcgtcatccgcgggcgcggcgtcagcgctggcgtcacccagccggtacgagtcgaagaagcggcgggactggaacacgttcgggcagtatctgcagaaccaccggccgccgctgtccctggcgctctgcagcgatgcgcacgagctggagatccagcgccaacctcaagcaggtcggcgagacaaaggtgcacaccacagcctgc

SEQ ID NO: 39064 - protein, 97 aa, Zea mays
  misc_feature: Ceres CLONE 1428556-F
MDLVPHPDSPHSDNSGGGGGSASGALSPEASSAGAASALASPSRYESKKRRDWNTFGQYLQNHRPPLSLALCSDAHELEIQRQPQAGRRDKGAHHSL

SEQ ID NO: 39065 - DNA, 648 bp, Zea mays
  misc_feature: Ceres CLONE 1428566-F
  misc_feature: Encodes the peptide sequence at SEQ ID NO. 39066
aaagctggagctccccgcggtggcggccgctctagaactagtggatcccccgggctgcaggaattcgcacgagaccattacctagaacatcctaatcgaaaaatataagcacggcggggtggaaccggacgtccctcgctcccaaatatctctccccacctcccctgagcttctcccgacctttggtcaggcaaaggaggcggccaacaaggacgagcgatggtgaccaaggtcatctgcttcctggtgctcgcatccgtgctcctcgccgtcgcttttcccgtgtctgctctgcggcagcaggtgaagaagggcggcggcggtgaaggcggaggcggaggcagtgttagcggaagcggaggcggcaacctgaatccctgggagtgctcgcccaagtgcgggtcgcggtgctccaagacgcagtacaggaaggcctgcctcaccttatgcaacaagtgctgcgccaagtgcctctgcgtgccaccggggttctacggcaacaagggcgcctgcccctgctacaacaactggaaaaccaaggaaggagggcccaagtgcccctagaagatccaccgcagctcccgtccgccattgtccccccttctccgaatctggaacgtgttgttcatcttcgaccaccccctaggc

SEQ ID NO: 39066 - protein, 114 aa, Zea mays; identical to SEQ ID NO: 34811
  misc_feature: Ceres CLONE 1428566-F
  misc_feature (2)..(114): Pfam Name: GASA Pfam Description: Gibberellin regulated protein

SEQ ID NO: 39067 - DNA, 787 bp, Zea mays
  misc_feature: Ceres CLONE 1428570-F
  misc_feature (286)..(286): n is a, c, t, g, unknown, or other
  misc_feature (394)..(394): n is a, c, t, g, unknown, or other
  misc_feature (533)..(533): n is a, c, t, g, unknown, or other
  misc_feature (645)..(645): n is a, c, t, g, unknown, or other
  misc_feature (684)..(684): n is a, c, t, g, unknown, or other
  misc_feature (686)..(686): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
aaagctggagctccccgcggtggcggccgctctataactagtggatcccccgggctgcaggaattcgcacgagaccattacctagaacatcctaatcgaaaaaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaaaactaatgtaggctccctctacagtctgatccacctacgtancaaaattagtgggaatcccccccggggctgcaggaaattccccccaaaaaccttttcccctaaaaaaattccttaatcccaaaaaaagggccccggcctttgtgtttngaaattgttttccacccaaaccgcgcaaaagggggagattttttttcccccctttcccccattttggggtcctgaaaaaaaagggggggggcccacccctaaacgccggggaggggggcccccctttggggggcgcccnaaaagttcgggcgcgctcgttcccccccccctttttttatcttggaggagggttgttttttttatataaaaaaaaaaacccttaaaaagaggggcgcccccccccccccccnttttgttttggaccacaccgaaaaaaaaagtgtgtttananccccccccccaccacacaaaaaaagggagggggggggttnnnttccaaattccctctgcgggagggaaaatttataaaaggggggggggggtgttcatttc

SEQ ID NO: 39068 - DNA, 632 bp, Zea mays
  misc_feature: Ceres CLONE 1428571-F
  misc_feature: Encodes the peptide sequence at SEQ ID NO. 39069
ggagctccccgcggtggcggccgctctagaactagtggatcccccgggctgcaggaattcgcacgagaccattacctagaacatcctaatcgaaaactttttttgagcgtgcgccctctctctctctctctctctctctctcccctatccgtgctttgtgcctgtttggtgcgcgtccacctttcggggtcaccggcttctgctttcttgctacgccaccgcgcctctcgtctatttatggagtcccccgatccatgaagccggggcaggccgagagttgtcaacgacgacgtctgccggcagtgctcctgctcctcctcctcctccttcccggccgccgcgcgagcttggtgggttagtgtctcttcttcgcggagacctgtgagaggagccatcatcatggccgccgttgagactgttgtcctcaaggttgctatgtcatgcgagggttgcgcgggggcggtcagaagagtgctctccaagatggaaggagttgaaaccttcgacatagacctcaaggagcagaaggtgacagtcaaaggcaatgtcaaagctgaggacgtcttccagacggtttccaagtcggggaagaggacctcctactgggagggcgaaaccacggccccggaacc

SEQ ID NO: 39069 - protein, 77 aa, Zea mays
  misc_feature: Ceres CLONE 1428571-F
  misc_feature (7)..(68): Pfam Name: HMA Pfam Description: Heavy-metal-associated domain
MAAVETVVLKVAMSCEGCAGAVRRVLSKMEGVETFDIDLKEQKVTVKGNVKAEDVFQTVSKSGKRTSYWEGETTAPE

SEQ ID NO: 39070 - DNA, 764 bp, Zea mays
  misc_feature: Ceres CLONE 1428580-F
  misc_feature: Encodes the peptide sequence at SEQ ID NO. 39071
aagctggagctccccgcggtggcggccgctctagaactagtggatcccccgggctgcaggaattcgcacgagaccattacctagaacatcctaatctaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccaatgtggcgggaagacactgcggaccacgaaagttatctcagcgtgccgcctgaggtatcttgcgaccaacgaatttgtcccggccattatcaagtggttctttggcttctgcaaaagaaaaaacgcgaggtgacaatcctgatacaattatatgggcatttgcttcatgcctttcaatttcgtgcatcccaatttcagtgggggacaataaaagaaataaaaaatacgggtaatacaaattgaagaaattttggtcccggccgaaaaaaccatcctggattggaacactggcaaaaaaaccgttcaaaaaaaaaatggttcaaaatcaacaggaccggttaattttttaaaag

SEQ ID NO: 39071 - protein, 119 aa, Zea mays
  misc_feature: Ceres CLONE 1428580-F
  misc_feature (17)..(115): Pfam Name: Ribosomal_S9 Pfam Description: Ribosomal protein S9/S16
MSTVLQRPTPGTVQCFGRKKTAVAVAYTKPGRGLIKVNGVPIELIRPEMLRLKAFEPILLAGRSRFKDIDMRIRVQCGGKTLRTTKVISACRLRYLATNEFVPAIIKWFFGFCKRKNAR

SEQ ID NO: 39072 - DNA, 732 bp, Zea mays
  misc_feature: Ceres CLONE 1428582-F
  misc_feature: Encodes the peptide sequence at SEQ ID NO. 39073
ggagctccccgcggtggcggccgctctagaactagtggatcccccgggctgcaggaattcgcacgagaccattacctagaacatcctaatcgaaaactcgttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagctgggctggacatgggcgcggcggcgaagcagtcgttgcgccccgtgaagcaggcgaagcaccacatgtgcacgttcgcgctgtacgcgcacgacccgaaagcggcaggtggagacgcaccactacgtctcccgcctcaaccaggacttcctccagtgcgccgtctatgactccgacaaagccgacgcgcgtctcatcggcgtggagtacatcgtggtcgaggaagatcttcgactcgctgcccggcggaggagcagcggcttgtggcactcgcacgcgcacgagatcaagtcaggcctgtggacaagcccgcacgtggcggggctgctggagaaggcggagctggaccacatggccgccacgttcggcaagttctggtgcacctggcaggtggaccgcggcgacggcctgccgctgggcgcccccgcgctcatggtgtccccgcatgacgaccccgccgcagccgtgcgcc

SEQ ID NO: 39073 - protein, 40 aa, Zea mays
  misc_feature: Ceres CLONE 1428582-F
MAATFGKFWCTWQVDRGDGLPLGAPALMVSPHDDPAAAVR

SEQ ID NO: 39074 - DNA, 735 bp, Zea mays
  misc_feature: Ceres CLONE 1428585-F
  misc_feature: Encodes the peptide sequence at SEQ ID NO. 39075
  misc_feature (735)..(735): n is a, c, t, g, unknown, or other
aagctggagctccccgcggtggcggccgctctagaactagtggatcccccgggctgcaggaattcgcacgagaccattacctagaacatcctaatcgaaaagcaccaccaccgtcactcaacacagcacaggcagctcgagagagagagagaaagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccggcgtcgtgctctgggagtggtgcaagggcgagaaccagagctggaagatcctgccgtggggtcccgaggcaactccgccgcggcccacgcgggaggcccgcacgccgtgcgcgtcttctgcn

SEQ ID NO: 39075 - protein, 192 aa, Zea mays
  misc_feature: Ceres CLONE 1428585-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTGVVLWEWCKGENQSWKILPWGPEATPPRPTREARTPCASSA

SEQ ID NO: 39076 - DNA, 736 bp, Zea mays
  misc_feature: Ceres CLONE 1428594-F
  misc_feature: Encodes the peptide sequence at SEQ ID NO. 39077
aaagctggagctccccgcggtggcggccgctctagaactagtggatcccccgggctgcaggaattcgcacgagaccattacctagaacatcctaatcgaaaagtcgctcttcgtcgtctccccccacaactgttatattcccaccggcgccgccggctcttcgtcgtcctcctccgggtgtgccccagttcgctgcccgttccccagccgccgatccctcgatctccgctagcttcgttccttcgtacaggaacggtcgagcagaaactagcagccactcccgagtcccgactcccgatcgcgattacttgccgcggcaccagtactccagcggccaccatgagcagcgggaagcgatccttcttcgcgcccaagaagaaggccaccaacccgttcgattccgactccgacgacgacaaaccgcagcagcggccagcgcgggcgtcctccgtgcctcccccggacgagcagcggggctcctcctctctcttcggcgccggcgacagaggcgggctcttctcttccgcggccaaccatcactaccggaacgacttccgcgacgctggcggccttgaaggccagtccgtgcaggagctggagggcctacccgcgtacaaggcccaggaaaccacgcgtccgacgcgggggttcgtcagggttccccaaaaagaaaaggaaaccccctcccaaatcccttgtcaccatccacccagcaggtgtagcaaatcctccccac

SEQ ID NO: 39077 - protein, 132 aa, Zea mays
  misc_feature: Ceres CLONE 1428594-F
MSSGKRSFFAPKKKATNPFDSDSDDDKPQQRPARASSVPPPDEQRGSSSLFGAGDRGGLFSSAANHHYRNDFRDAGGLEGQSVQELEGLPAYKAQETTRPTRGFVRVPQKEKETPSQIPCHHPPSRCSKSSP

SEQ ID NO: 39078 - DNA, 685 bp, Zea mays
  misc_feature: Ceres CLONE 1428595-F
  misc_feature: Translation starting site: 172
  misc_feature: SWISSPROT Homolog: EC 1.2.1.12 Glyceraldehyde-3-phosphate dehydrogenase (phosphorylating)
  misc_feature (459)..(459): n is a, c, t, g, unknown, or other
aaagctggagctccccgcggtggcggccgctctagaactagtggatcccccgggctgcaggaattcgcacgagaccattacctagaacatcctaatcgaaaaatccgctgcctccgcctctcgagtctcgtccacccgtcatcctcctagctcctctactcgccagtcgccatgggcaagattaagatcggaatcaacggcttcggaaggatcggcaggctcgtggccaggtcgccctccagagcgaggatgtcgagctcgcgccgtcaacgaccccttcatcccacggactacatgacctacatgttcagtacgacaccgtcacggccactggaagcacagcgacatcacactcaaggactccaagacccttttctctcggtgacagccggtcaccgtctttggcatcaggaaccctgaggaaaatcccgtggggtgaagctggcgctgagtatgtcntggagtccaaccggcgtctttccctgacaagaacaagctgctgcacatttccaagggtggggccaaaaaggtggtattcctgcccccaaaaaaagaacacccctgttttgtgtgtgggggcaaaggaggaaaatccccccccgaaaggtaaaattggtttccaagggaggggggccaccaaaaggcgttgggtccccctgggaaggggtttctgaaaaaacttggg

SEQ ID NO: 39079 - DNA, 699 bp, Zea mays
  misc_feature: Ceres CLONE 1428597-F
  misc_feature: Encodes the peptide sequence at SEQ ID NO. 39080
  misc_feature (699)..(699): n is a, c, t, g, unknown, or other
ccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccaccggcgcccggagcgttccccgtgccaggggctcgttccttagcggcgcccaaaggggagggccccccccccctgggcccccgtggggggcgtctttccagttccctttcccccgggggggtgttgggggccccaaaggggttcccccgttttttcaaggggccccaaaggggccccccggcccccgtggcccccttggggggggtcccacccttgccccttgtttttttgtaaaaagagggggcgtttn

SEQ ID NO: 39080 - protein, 118 aa, Zea mays
  misc_feature: Ceres CLONE 1428597-F
MAPLPASLTPCLWLFLCLLAAPCPAARAARFACNATGARSVPRARGSFLSGAQRGGPPPPGPPWGASFQFPFPRGGVGGPKGVPPFFQGAPKGPPGPRGPLGGGPTLAPCFFVKRGGV

SEQ ID NO: 39081 - DNA, 721 bp, Zea mays
  misc_feature: Ceres CLONE 1428614-F
  misc_feature: Encodes the peptide sequence at SEQ ID NO. 39082
aagctggagctccccgcggtggcggccgctctagatctcgtggatcccccgggctgcaggaattcgcacgagaccattacctagaacatcctaatcgaaaaaaatccatatttgtcccagcgaaggcacacagccgccgccatttcttcatcctcccatctcctgatctccatctccatcttcttcgcagcgccggcgatccatcttccgctgcctcccttcctcgcgctcgggctctcagtgacggcatcagcggtttcccctcccgcctctcgccagtcgcatcacgcccccgcctccggtccaccgcacaccggccggtgaccctacattacttgctaatctttcttgagggcagatggccgtttcttttgcaaatgtcaacgccgaggcagggctgaaaaagcttgatgagtaccttctcactcgcagctacatcactggctaccaagcttccaaggatgacctggctgtctactcttcatttttggctgatccctcatccaagtatatcaatgtagcaaggtggtttaatcacattgatgcactcctgaggctgagtggagttaccgcagagggcctaggtgttaaggttgagccatcagcggttccttcagcttcaattcttgatgttgctgatggacaggccccagctgctgacgaggatgacgatgatgatgttgacctttttgggcgagagactgaaagagagaaagaagct

SEQ ID NO: 39082 - protein, 121 aa, Zea mays
  misc_feature: Ceres CLONE 1428614-F
  misc_feature: SWISSPROT Homolog: EC 6.1.1.16 Cysteine--tRNA ligase
MAVSFANVNAEAGLKKLDEYLLTRSYITGYQASKDDLAVYSSFLADPSSKYINVARWFNHIDALLRLSGVTAEGLGVKVEPSAVPSASILDVADGQAPAADEDDDDDVDLFGRETEREKEA

SEQ ID NO: 39083 - DNA, 776 bp, Zea mays
  misc_feature: Ceres CLONE 1428616-F
  misc_feature (389)..(389): n is a, c, t, g, unknown, or other
aaagctggagctccccgcggtggcggccgctctataactagtggatcccccgggctgcaggaattcgcacgagaccattacctagaacatcctaatcgaaaaactccgatcctgccctctaataacagcagcagcagccgccatggaaggcagcagcaagaagctccagccgttcctcctcacgctgctgctggtgctctccaccgccgtgacgcccatcctctcgctgtcagtgccagacgacgaggtagcctgcgactgcgacaaacccaaggcgcccaagccgtcgcacccgcccaagaccaagccctcccacccgtcgccgaagcccaagaaccccaagccacccaagggcggcaccgggtacccggcgccagggcaccaaccgnccaataacctctccttaccccccgtgtcctcgtcccctcgcaatattcccctgacagtgcccgccattgcatcgcttctccgagtcatctgtccccacggacggcctcgtggactccgcacctcccctgctctcgccccccgtgtccgtatgagcttctaccctcccccgcacacgacgcatatgatttttctcctgcggcccctgtccctcccgtctgcacatccttcgaccccacctattcctctcacccagcccgctcacctatctctcctcctgctatgcccaacccccttttcctctctatatgacattggttacactcctacctcccctccaacgtgttacgccctgtggacctgcacactaggctgcctacctcctctcg

SEQ ID NO: 39084 - DNA, 719 bp, Zea mays
  misc_feature: Ceres CLONE 1428619-F
ccccgcggtggcggccgctctagattagtggatcccccgggctgcaggaattcgtaccagaccattacctagaacatcctaatcgaaaaaacaaagaaaccactgccagttcatataccacaatcttcttgtagcacaccgactgtgcttccatcaactccgccgccatgtttgggagctgcaaggggggcaagggcgctgggccagggccgcatgaaacgccgccgtaaggttctcctctacaacataccagggtatcacgaagccggcaatccggacgctgaggaggagcggcagcactgaagcgtatctcccggcttatctactatgaaacccgcggcgggttcaagatcttcctcgagaatgtcatctccgacgcggtctcctactcctagcacactcgtcgcaagaccgtcaccttcatggatattgtgtacgccctcaagagccagtgccgcactctgtactggatcggcggttgatcgcatctcttcactactctgcagcagctgcctgtggcgattcctcagttccatctgccttgcttggcttgatgctcagagttatcagattaaaatatcactgatgtgcttctgaatagcctggaatcatgtgccccaacactgctcgtaaatacagatcatcatgtatctgtactatgcgttctgaaaatgtcaaagcgagatcgaaaataaagataaataacttacctaagccgg

SEQ ID NO: 39085 - DNA, 686 bp, Zea mays
  misc_feature: Ceres CLONE 1428623-F
  misc_feature: Encodes the peptide sequence at SEQ ID NO. 39086
acccgcggtggcggccgctctagtactagtggatcccccgggctgcaggaattcgcacgagaccattgcctagaacatcctaatcgaaaaattttccgtacgccgtacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgcccctcgccggggtccgggtcgagtcgctcgacctgttccagtgccccgtcaccaggtcaagggggaaagggatgaggtcttcgcgctgattccaaccctcaagtacctcgatggcgctgacgctgagggcaacaagcggtttggagacggatg

SEQ ID NO: 39086 - protein, 151 aa, Zea mays
  misc_feature: Ceres CLONE 1428623-F
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLGNNRFAEVQELAPLAGVRVESLDLFQCPVTRSRGKGMRSSR

SEQ ID NO: 39087 - DNA, 714 bp, Zea mays
  misc_feature: Ceres CLONE 1428624-F
  misc_feature (714)..(714): n is a, c, t, g, unknown, or other
aaagctggagctcaccgcggtggcggccgctctagaactagtggatcccccgggctgcaggaattcgcacgagaccattacctagaacatcctaatcgaaaaattctcgatccctctacctctcgcatccggtgcctggctgccagccccagcgctcgccaacctcatcttccccggcgtttcctcctagctccctccaccatgccgctgccatggaactcactgctcggccgcgccctggccatgctccctgcgctcgccagccgtgcgcatctccctctgcgcgcgctcctacgtcctgcgccgcgaaccccgctgtggagcttccccgagctcgccccatggcgcccggccgagctcctccctgccgtgttcttgctcggcgtccagttttcctgtgtgccgcggtcttcctccccgagctcaccccagccccttgtattccccatggccggagcttcttccagctccagctcggctccctctcccatggctctctgcgcgctagccgctgtgcgcccatctatctctcgtggatctccctccccagctcctctctgctcgcgccgtcacccagcctgttggcacacgcactcctctgtcgcacgctcctccaagtcagagctccctctggccgttcccatggtcgcccctctctcagcttcatcttcagctgctcggctcccaggtgcgcgcgttcttgtgttcacgccn

SEQ ID NO: 39088 - DNA, 723 bp, Zea mays
  misc_feature: Ceres CLONE 1428626-F
  misc_feature: Encodes the peptide sequence at SEQ ID NO. 39089
tccccgcggtggcggccgctctagaactagtggatcccccgggctgcaggaattcgcacgagaccattacctagaacatcctaatcgaaaaaatagcatctgcctacctgcactggactcaaaaacatgcctgccgtaggatcctgtgatgtgtccattcgcgtgttgagtcggcggcttgtgaaggcatccgacccctccctccagccgcacgtcgtcaccttctcaaacctagatctctacccggacaacgtgcaggcctccatagtgtgcctctaccccaagctgtcaacaaagtccggcccgggcggcggcttcgacgccgtcgtctccaccttcgaggccgtcctgccgaccttgcttaaccacttctaccctctcgccggtcgcattgtcgtcaacccaagctccggcgtccccgagctccactgccacaaccagggcgcggagctcgtggtgggagaggtcggcgtcgccctgggcagcctggattacggtcttgccgaggagtccctgaagaagatcatgatgccgtaccctgaggacgtcacgctctcggtgcagctgctgtccttcgcgtgcggcggcttcatcgtcgtgtgggacaacaaccaactcctcaacgacgggcacgccatcaccatgtgcgtcaagatgtggtccgagctggcacgggtcggctggagcatcgccacccttgggagcggtgtcgaggaaccacga

SEQ ID NO: 39089 - protein, 199 aa, Zea mays
  misc_feature: Ceres CLONE 1428626-F
  misc_feature: SWISSPROT Homolog: EC 2.3.1.160 Vinorine synthase
MPAVGSCDVSIRVLSRRLVKASDPSLQPHVVTFSNLDLYPDNVQASIVCLYPKLSTKSGPGGGFDAVVSTFEAVLPTLLNHFYPLAGRIVVNPSSGVPELHCHNQGAELVVGEVGVALGSLDYGLAEESLKKIMMPYPEDVTLSVQLLSFACGGFIVVWDNNQLLNDGHAITMCVKMWSELARVGWSIATLGSGVEEPR

SEQ ID NO: 39090 - DNA, 529 bp, Zea mays
  misc_feature: Ceres CLONE 1428629-F
aaagctggagctccccgcggtggcggccgctctagaactagtggatcccccgggctgcaggaattcgcacgagaccattacctagaacatcctaatcgaaaaacccccacgccccaccccaccaaacaatggcgccggcggcgacttccacagcctctgcgccctcctccttccactccactggtaggatagggccagggtcggggcccggccatcgctcgtctctctccgcgtcagagcagccaatccaacgttaccgccgatcccgcaccggcccctttccagtccggtcacgggcctttcgcgccaggccaacgtcgccaaaccttcgggcccggggtttccaaatttccctccgagaaggggccctttcccccaaacacccccccctccccctgggggaaaaaccttcacccaaaacccttggaaaccctttttttccccccccccgccacccgtttccaaatggcccccaaaaaaaatcccccgggcccggcccaaaaaattttggggaaaaaagccccctttt

SEQ ID NO: 39091 - DNA, 831 bp, Zea mays
  misc_feature: Ceres CLONE 1428632-F
  misc_feature: Encodes the peptide sequence at SEQ ID NO. 39092
cgcgctccttatttgtactagtggggcacataaatctccgtcttattcaaactggagctccccgcggtgggggccgctctagactagtggatcccccgggctgcaggaattcgcacgagaccattacccagaacatcctgatcgaaaacactgaaacgaaattaccctatagggatgagatttaaaatgaggtttgaaggtgaagaggctccagaacaaaggttcactgggaccattgttggaaatgtggatcctgatcaagctggatgggctgaatctaaatggcgttacctcaaggtgaggtgggatgaaagcttcctccgttccacgtcctgaaagggtttctccctgactaatatgatcctgcagtcagccctccccctgatcacccggttccagtggacagtcccaatagaccgcgctctaaggcgtttagcttctctgcccggatcttcagccccaactaaagaagctgcctccaaaggccgggtggaagactcaacattttggccctggatagggtcgggagcacacccaggataatggggccccggaaaagggtttgttggcaaaagacaggtgaattcggagtcttgcggaatgagtcctacgccgtggacccttctaagttttatctcgggaacaacgaacgcatttatccttggatagaggtaacgagggtagcaaatgttacgagattagcaaggaaacttccgcctcggcgggtgaccgctttgtcactgttttgtcgggaggtatcaggggcgccgggtgacccgaccgtgtggcttggggcgcgcgcggcggtatcctcgatatgcgagagcagcg

SEQ ID NO: 39092 - protein, 53 aa, Zea mays
  misc_feature: Ceres CLONE 1428632-F
  misc_feature (1)..(41): Pfam Name: Auxin_resp Pfam Description: Auxin response factor
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
MRFKMRFEGEEAPEQRFTGTIVGNVDPDQAGWAESKWRYLKVRWDESFLRSTS

SEQ ID NO: 39093 - DNA, 833 bp, Zea mays
  misc_feature: Ceres CLONE 1428638-F
  misc_feature: Encodes the peptide sequence at SEQ ID NO. 39094
  misc_feature (14)..(14): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (40)..(40): n is a, c, t, g, unknown, or other
  misc_feature (48)..(48): n is a, c, t, g, unknown, or other
ggggttctccgggntgtgttgtgggggnnnnnncaacccncgcgctcncttaaagcggtggctcaccgcggtggcggccgctctagactagtggatcccccgggctgcaggaattcgcacgagaccattacctagaacatcctaatcgaaaaagtacgttcgctagctcccttccgttcccttcccacgaaaaccggagagggagtgagaagaagcaacaagaagcggagagccaacgcgcaacgcgacgccctgagatggcggcgccggcgccggcgccgaagcaggaggagctgcagccgctcgccgtcagggaccagctgccctccgtctcctactgcctgacaagcccgcccccatgggcggaggccggccttcgtcgggcttcgggaactaaactcggcaagcacagcaaaccccggcatcatctccacgggggctcgtgccgcccaaatgggccggcgtgctttgatatagaaacccccccccgtgggggcaggagcgttgctttttgccatggggcggggattccacctcgcgactagggccaagaaattttccttgcgggaacgtggggcgaacccccagcccgtccatggggcggacacctccctagcagacccttgcaatcgcagcgcgggacaaaacatactaggaaaaacgggcaaccggtttcgtgtgagggctctactatacctccctcattcccccgcaggagtataaataccttagcccacatcactggcaaaagtaaaccaagaggtagcgactccattaggagggccggccacacccagcgaaggaaaaacgggcggggcgctgaggagggggga

SEQ ID NO: 39094 - protein, 95 aa, Zea mays
  misc_feature: Ceres CLONE 1428638-F
MAAPAPAPKQEELQPLAVRDQLPSVSYCLTSPPPWAEAGLRRASGTKLGKHSKPRHHLHGGSCRPNGPACFDIETPPRGGRSVAFCHGAGIPPRD

SEQ ID NO: 39095 - DNA, 684 bp, Zea mays
  misc_feature: Ceres CLONE 1428639-F
  misc_feature: Encodes the peptide sequence at SEQ ID NO. 39096
cgctctatatctagtggatcccccgggctgcaggaattcgcacgagaccattacctagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcgtccgggctagacgccgacggcggcaagcggagccatttctccagcatcagaggtgacgacggccagaggtcgctcgacgcagtggtaaaaacggccgggcagggagcccttccagtggggggttggcagccgggagtctactcagggctcacggtacccgcttgccggaggccagggggatggccacgacttggaagaaacagcgcccttcgcaagggccccatcgcttgggggcggcggggggcgccttcacgggtggaacgccggggggccccactcccgaacaaggttcgttaaacttttgcccattac

SEQ ID NO: 39096 - protein, 162 aa, Zea mays
  misc_feature: Ceres CLONE 1428639-F
MSTLDTRTLKDELTSMDRKCLVDLGHPLLNRVADSFIRAAGVGAARAVSREAYVVTVEGLSGDSSGLDADGGKRSHFSSIRGDDGQRSLDAVVKTAGQGALPVGGWQPGVYSGLTVPACRRPGGWPRLGRNSALRKGPIAWGRRGAPSRVERRGAPLPNKVR

SEQ ID NO: 39097 - DNA, 703 bp, Zea mays
  misc_feature: Ceres CLONE 1428641-F
  misc_feature: Encodes the peptide sequence at SEQ ID NO. 39098
  misc_feature (537)..(537): n is a, c, t, g, unknown, or other
gcggtggcggccgctctagttctagtggatcccccgggctgcaggaattcgcacgagaccattacctagaacatcctaatcgaaaaacaacacgtccgcatactcccaaccaaatctccctccagcgccgcagctagcccgagaagccgacgaggaggaaaccgaccgccgacgccgagcaccctcggttccttgcttgcccggcgcccaatctagacagctctttctcgttcgtctgtatccatggccgcctcgagcaagaccatcgctgtcctcctcgccgcgctgctcctcgcgctggtcgcgtccgcggtggccagcaggaagctggaggaggaggacgctttcctgggaagcctttcgccggcgcctgcccccgccgagggcggagccgcggggctcgctagcggcacgccgggggcgtgggccgtcgccgctctggtctctctcatcgccttcctcgcgaactgagcgggtcctgcgatctggattgctgcgggcggaggggaacatttatgctcgccctgtttgttctangctatcggttccagtgctgctgacctctcttttggctgtataagagaggattacgcaccgtttcattttatactacttatctgttaatctgttaaaaaaaaaaaaagcttatcgataccgtccacctcgaggggggggcccggtaccaaattcgccctatagtgag

SEQ ID NO: 39098 - protein, 75 aa, Zea mays
  misc_feature: Ceres CLONE 1428641-F
MAASSKTIAVLLAALLLALVASAVASRKLEEEDAFLGSLSPAPAPAEGGAAGLASGTPGAWAVAALVSLIAFLAN

SEQ ID NO: 39099 - DNA, 741 bp, Zea mays
  misc_feature: Ceres CLONE 1428644-F
  misc_feature: Encodes the peptide sequence at SEQ ID NO. 39100
  misc_feature (718)..(718): n is a, c, t, g, unknown, or other
aaactggagctccccgcggtggcggccgctctagaactagtggatcccccgggctgcaggaattcgcacgagaccattacctagaacatcctaatcgaaaaatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcggctccgaggcccggcccagggtttctctgcgtggtacgagcccttcccgccggcgcccggcggcgacccgaacgagcgctactcgctggacgaggtcgtctaccgctccagctcggggggcctcctcgacgtgcgccacgacatggaggcgctggcccgctacccggggtcctactggcgtgacctcttcaactcccgctgtcgccgcaacgcctggccctacggcttgggcgtctggtccaagaaaggagttccggtctccccgtggatagaatgcagaaccacatcgtgctccccttttgtgaggggcaacctccccccttctatcaagggctttaattatctnacagacagaaaagcacgtgccgg

SEQ ID NO: 39100 - protein, 192 aa, Zea mays
  misc_feature: Ceres CLONE 1428644-F
  misc_feature: SWISSPROT Homolog: EC 4.2.3.1 Threonine synthase
MATFTAASSLSLLFSHPHSHSRQPSAQGPTASSHLHLHPRASRARCASSDTTATKHRRPAEENIREEAARLRGPAQGFSAWYEPFPPAPGGDPNERYSLDEVVYRSSSGGLLDVRHDMEALARYPGSYWRDLFNSRCRRNAWPYGLGVWSKKGVPVSPWIECRTTSCSPFVRGNLPPSIKGFNYLTDRKARA

SEQ ID NO: 39101 - DNA, 658 bp, Zea mays
  misc_feature: Ceres CLONE 1428645-F
  misc_feature: Encodes the peptide sequence at SEQ ID NO. 39102
  misc_feature (642)..(642): n is a, c, t, g, unknown, or other
  misc_feature (648)..(648): n is a, c, t, g, unknown, or other
  misc_feature (650)..(650): n is a, c, t, g, unknown, or other
  misc_feature (651)..(651): n is a, c, t, g, unknown, or other
aaagctggagctccccgcggtggcggccgctctagaactagtggatcccccgggctgcaggaattcgcacgagaccattacctagaacatcctaatcgaaaagacccgtcacagtcccaggtccctctgcgtcccgtaaatcctagccgcgatttatggtccgaaagcgccgagcgccttcgcctcctccgcctccgcaggaagagtcgtcctctgaggaatctggcttcgaagagatggaggagcctcctcgcctccccgagctgcgtaatccctcgcatgccgcggcctacaacgacgactctgcggaggaggacacggactccgacaccgacgctcaatctttccacgatgctccaggtgccccgctccctcactaagcatactcatccagttccccggccagaattcccatccccagaaggaggggggggagcctcccgaggggggggagggtggaaaccccctttgcccgtggggtacaaacaaaaggggggccgcccagggccgcccccccccggtgtttccatggcaatatcgaaaggaagaaaaacccccccggaaaacggcgccctccccgaaggaaaaaaaaaaaaaaaggggggggctaccctcccccccggcgaaagaaggaaacccccntccacnanntccaaga

SEQ ID NO: 39102 - protein, 74 aa, Zea mays
  misc_feature: Ceres CLONE 1428645-F
MVRKRRAPSPPPPPQEESSSEESGFEEMEEPPRLPELRNPSHAAAYNDDSAEEDTDSDTDAQSFHDAPGAPLPH

SEQ ID NO: 39103 - DNA, 703 bp, Zea mays
  misc_feature: Ceres CLONE 1428653-F
ccgcggtggcggccgctctagattcgtggatcccccgggctgcaggaattctcacgagaccattacctagaacatcctaatcgaaaaactaaaaacatgggactccaccctgtctccgaggccaacgcttcaagccccttcggctctctctccgccgccgaattctactccctccattccgtcgcccactcctccgcctacatcaccaacccaaccggtctcaaactcttcacccaatggtggacccctctccaccgtccaccactcggcctcatcgccgtcgtccacggcttcaccggcgagtccagctggttcctccaactaacctccgtcctcttcgccaagtcagggttcctcacttgcgccatcgaccaccaaggccacggcttctccgacgggctaaccgctcacatccccaacatcaacctcatcgtcgacgactgcatctccttcttcgacgacttccgtagccgtcacgcttcctcctcctccctaccttccttcctctactccgagtccctcggcggcgcgatagctctctacatcaccctccgccagaaatcaaaatggaacggtctcatcctcagcggcgccatgtgctccatcagccacaagttcaaacccccgtggccgttacaacacctcttaaccctcgccgctactctcatccccacatggcgcgtcgtaccaactcggggcaccc

SEQ ID NO: 39104 - DNA, 722 bp, Zea mays
  misc_feature: Ceres CLONE 1428658-F
  misc_feature: Translation starting site: 152
  misc_feature (679)..(679): n is a, c, t, g, unknown, or other
  misc_feature (683)..(683): n is a, c, t, g, unknown, or other
acaagctggagctccccgcggtggcggccgctctagaactagtggatcccccgggctgcaggaattcgcacgagaccattacctagaacatcctaatcgaaaaaaaatcctccacaccctggactggagtggctgctgctcgtggccggcgatgagcggcggcgggcccggaggtgcgtgcgggccggactcccgcgtggagaccatctcccggctggcgcagtggcgcatcgataccttcggcccctgctcctaccgccggtcggacccctttaagctcggcatctggaactggtacctgtcggtggagaagagccgctccatcgttgtgcgcctcttcccggagcccggccgggtggccaaggagcagccccctctcgcgcgcttcctgctccgcgtctcctgggccggcccgccgcgacgctcctgcgtctcccctgtgcacgagcatcttctgcgtaccagcgatgattttgtatgggcagtcgatgcgatgtcccatgggcgttttacgattgatgttgagtttctagacctgaggatagccacgaaacatgctacggaatcgtcatcggtgtgggcaaacgaaggcatggtgcaaaagatcgcgagcaagagcgccctggggctgcctgtcgcgcatgctggcggactccatccacgccgacgtgaccatcancacnacggacggggtgcttgaagcccacaaggcggtgcttgcg

SEQ ID NO: 39105 - DNA, 700 bp, Zea mays
  misc_feature: Ceres CLONE 1428662-F
  misc_feature: SWISSPROT Homolog: EC 3.1.1.31 6-phosphogluconolactonase
ccccgcggtggcggccgctctagtctagtggatcccccgggctgcaggaattcgcacgagaccattacctagaacatcctaatcgaaaaacctccgtctccgccgccgccgttgccgctctcgtcccacccctcaccggccgccggtcgccgccggcatctcgcgtaccgcatatttgccgcagaagaatcagatccaaaccccgtatcttctcttcttccccctccttccccattgtccccgccgctgccatggccaccgggggtgccgcccccaccgcctcctatgccgggtccaagaagaagttgctcatcttcaactcctaggaagatctcgcggtttctcttgcgaagtacactgcggagctgtcggagaagttcacgaccgataggggtgccttcaccgccgtgctctctggcggatccctcatcgaggcactcaggaagctgaccgagccgccgtacctggattcagtggactggagcaagtggcacgtcttctgggtggatgagagggtcgtgcactatgaccatgtggatagcaactacaagctcgcctatgatgggtttctctccaaggtgccgattccgtctggacaagtatatgctataaacgatgcgatgtcagctgaacgagctgcagacgactactaagcgtgcctgaagcatcttgatcagaacggcgtgatttctatgtcagc

SEQ ID NO: 39106 - DNA, 674 bp, Zea mays
  misc_feature: Ceres CLONE 1428666-F
  misc_feature: Encodes the peptide sequence at SEQ ID NO. 39107
  misc_feature (264)..(264): n is a, c, t, g, unknown, or other
  misc_feature (267)..(267): n is a, c, t, g, unknown, or other
  misc_feature (337)..(337): n is a, c, t, g, unknown, or other
  misc_feature (397)..(397): n is a, c, t, g, unknown, or other
  misc_feature (416)..(416): n is a, c, t, g, unknown, or other
  misc_feature (439)..(439): n is a, c, t, g, unknown, or other
aaagctggagctccccgcggtggcggccgctctagaactagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcancancagcagggaagaaggcggcgcccgatgggtgagcaggtgaaggggcatgctccacgacaaggggccgacngcgtcccaggcgctgaacgtggtgaccctgtcccccctgggccggctgctgctggtgctngtcgggcctggccctaacngcctccgtgggtgggcttgcccntggccacccccggttttcctgatctttcaagcccctggttcgtccccgccccgcttgctcatgggaacggcccgtcatggggtttcctcaccttccggccccccttggggctccgggggccttttcctccctcaagtggcctccccaaaagggggggggggagggggttccccccccccccccgggactaaggtggaagaaggcccacccgcaaggaatggcgaaagccccccgc

SEQ ID NO: 39107 - protein, 120 aa, Zea mays
  misc_feature: Ceres CLONE 1428666-F
  misc_feature (35)..(35): Xaa is any aa, unknown, or other
MLHDKGPTASQALNVVTLSPLGRLLLVLVGPGPNXLRGWACPWPPPVFLIFQAPGSSPPRLLMGTARHGVSSPSGPPWGSGGLFLPQVASPKGGGGGGSPPPPGTKVEEGPPARNGESPP

SEQ ID NO: 39108 - DNA, 753 bp, Zea mays
  misc_feature: Ceres CLONE 1428668-F
  misc_feature: Encodes the peptide sequence at SEQ ID NO. 39109
  misc_feature (21)..(21): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttgttcccccttgagggtgcntctgtgatataatgtttgaccacnnnnttcaaactggagctccccgcggtggcggccgctctagaactagtggatcccccgggctgcaggaattcgcacgagaccattacctagaacatcctaatcgaaaactcgcgggctttcccgcagcaagatcaacgtcgtcgttcaagccagcggtagtagagactacgaccgaggctagctaagctaagagatggcggatcaccagtactcggcgtggacgacttccgctgctcgtcatagggtcttctcctgtgcgctcatggctcttgttagttttgtggctgcaggacgacccatggtgctcgccgacgccatcgtctttcacgtggcgaacaggtgcccgttcccggtgtggccggcgtccgcccctaacaccggccacccagtgctcgccggcggcggcttctacgtcccgcagggcaagtcgaggcgcgtcgtcgcgccggccaactggaacgggcgcttctgggcccgcaccggttgcaacttcaccgcgaacggcatgggcgtagcgggctgcctcaccggcgactgcgagggccggcttcccctgtaacggggcccggggggcgccccgccccgccacgcctagtcgggggtgaaccctgccacgaaggacccccccgaaaaggggagcctccctaccaaccgtggagcccttgggggggacgggggtaacaaaacccttccccccggtcggcccgt

SEQ ID NO: 39109 - protein, 121 aa, Zea mays
  misc_feature: Ceres CLONE 1428668-F
MADHQYSAWTTSAARHRVFSCALMALVSFVAAGRPMVLADAIVFHVANRCPFPVWPASAPNTGHPVLAGGGFYVPQGKSRRVVAPANWNGRFWARTGCNFTANGMGVAGCLTGDCEGRLPL

SEQ ID NO: 39110 - DNA, 708 bp, Zea mays
  misc_feature: Ceres CLONE 1428671-F
  misc_feature: Encodes the peptide sequence at SEQ ID NO. 39111
  misc_feature (492)..(492): n is a, c, t, g, unknown, or other
ctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccangctgactgtgctgtcctatcattgactcccacactgtggttttgaggcctgtatccccaggtaggccagacccgtgaacatgctctccttggtttcccccttggaaggaaccaaaaaatttccctcctccaaaaaatggatccaccccccccaaaaccccagggccctttataaaaatttgtgaaggaatcctcccctcccccaaaaagttgggac

SEQ ID NO: 39111 - protein, 122 aa, Zea mays
  misc_feature: Ceres CLONE 1428671-F
  misc_feature (5)..(119): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (108)..(108): Xaa is any aa, unknown, or other
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSXADCAVLSLTPTLWF

SEQ ID NO: 39112 - DNA, 715 bp, Zea mays
  misc_feature: Ceres CLONE 1428672-F
  misc_feature (715)..(715): n is a, c, t, g, unknown, or other
tacccgcggtggcggccgctctagtttcagtggatcccccgggctgcaggaatttgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagctggcaaacctttctccctactctcagcaacaacaatttcttccattcaaccaactgtctacactgaaccctgctgcttatttgcagcaacaactattaccatttagccagctagctactgcctactctcagcaacaacaacttcttccan

SEQ ID NO: 39113 - DNA, 666 bp, Zea mays
  misc_feature: Ceres CLONE 1428674-F
  misc_feature (276)..(276): n is a, c, t, g, unknown, or other
  misc_feature (297)..(297): n is a, c, t, g, unknown, or other
  misc_feature (452)..(452): n is a, c, t, g, unknown, or other
  misc_feature (505)..(505): n is a, c, t, g, unknown, or other
  misc_feature (516)..(516): n is a, c, t, g, unknown, or other
  misc_feature (596)..(596): n is a, c, t, g, unknown, or other
aagctggagctccccgcggtggcggccgctctagaactagtggatcccccgggctgcaggaattcgcacgagaccattacctagaacatcctaatcgaaaaatccccctgtgctctcctctcgtggccttgtttcctggcggcgacggctggtcgagcggcgccgcccttggctaggtcttcgctggggtccttccccggcgacgagcgtccatctggggtcgactgaactgagcaggcagtaggaagagacactatgttgttcttctcctacttncaggagctggtggggaagganggtgacagtgagctcaagaatgacttggcgatccgcggacgctccactcggttgaccagtaccctcacatcaagctcgagaacacccgcgtagtcgaccaaggacagtatccccacatgctttcagtgcggaactgcttcatcagggggctcggntggtgcgtacgtgctgctcccgcaggacggcgtggacatcgacatcctccacnacgccaccagnagggaggcccgcggaggctgatcctgatgcgcacccgctccctcacctgctggctgctgcttcatccccgattgtacaangccatgcctgtacggtgtgtggtaaacagatgccccagttttagttctttggtgcttggctttacataaa

SEQ ID NO: 39114 - DNA, 661 bp, Zea mays
  misc_feature: Ceres CLONE 1428684-F
  misc_feature: Encodes the peptide sequence at SEQ ID NO. 39115
cgctctagatctagtggatcccccgggctgcaggaattcgcacgagaccattacctagaacatcctaatcgaaaacaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgagttcgaccggctgagcgcgctcggcccggtggccaccctcgccggctcgcagtacacgctgaacctcacctacgacatgg

SEQ ID NO: 39115 - protein, 162 aa, Zea mays
  misc_feature: Ceres CLONE 1428684-F
  misc_feature (64)..(161): Pfam Name: Fasciclin Pfam Description: Fasciclin domain
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFANLTQDQLRSLLLCHALPKYYSLAEFDRLSALGPVATLAGSQYTLNLTYDM

SEQ ID NO: 39116 - DNA, 720 bp, Zea mays
  misc_feature: Ceres CLONE 1428693-F
  misc_feature: Translation starting site: 589
  misc_feature: SWISSPROT Homolog: EC 2.7.11.1 Non-specific serine/threonine protein kinase
  misc_feature (530)..(530): n is a, c, t, g, unknown, or other
aagctggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacgacgaggtgtcgcgcatgaggnaaggaagcgggacgcggacggcgacggctgcatcagcctgcccgagttcgccgcgctcatggagtccgcgtccgccgacgccgccgccgtcgaggaggacctgcgccacgccttcatggtcttcgacgccgacggcaacggcctcatcacgcccgccgagctcgcgcgcgtcctgcgcggcctcggggag

SEQ ID NO: 39117 - DNA, 691 bp, Zea mays
  misc_feature: Ceres CLONE 1428713-F
  misc_feature: Encodes the peptide sequence at SEQ ID NO. 39118
cccgcggtggcggccgctctatcctagtggatcccccgggctgcaggatttcgcacgagaccattacctagaacatcctaatcgaaaaaaccaaacgcaatggtttgttctctcattctcttttgtctcctttctctttgtaatgaagttgtgttatagatatgaatattgtttcttgttatgcttttatttatttgcgttcacataagatcatattggtttattgtcccatttacaatcttggattacggtttatccatatactatgaattggaaaggcgaacgcagcgtcaggaatggcggtggaagacgaatgtaagttgaagtttttggagctaaaagcgaaaagaaactataggttcataatattcaggatagacggacaacaagtggtggttgagaagcttggaagtcctgaggagaactacgacgatttctccaattccttacctgccaatgagtgccgctacgctgtctatgacttcgacttcaccactgctgagaattgccagaaaagcaagatcttcttcatagcatggtcaccggattcgtcgagggtaagaatgaagatggtgtatgcgagctcaaaagacaggttcaagagagagttggatgggattcaggtggagttaccagccacagacccgagcgagatgagtttcgacatcatcaaaagtcgagctctctagat

SEQ ID NO: 39118 - protein, 130 aa, Zea mays
  misc_feature: Ceres CLONE 1428713-F
  misc_feature (5)..(130): Pfam Name: Cofilin_ADF Pfam Description: Cofilin/tropomyosin-type actin-binding protein
MAVEDECKLKFLELKAKRNYRFIIFRIDGQQVVVEKLGSPEENYDDFSNSLPANECRYAVYDFDFTTAENCQKSKIFFIAWSPDSSRVRMKMVYASSKDRFKRELDGIQVELPATDPSEMSFDIIKSRAL

SEQ ID NO: 39119 - DNA, 685 bp, Zea mays
  misc_feature: Ceres CLONE 1428716-F
tccccgcggtggcggccgctctagaactagtggatcccccgggctgcaggaattcgcacgagaccattacctagaacatcctaatcgaaaaccatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtccccaagatcctggagctcggggacgcatcgccgggctcacgctcgaggaggcccgcagcctcgtcgaccacctccagagcggctcggcgtcaccgcccgcggcttccgcgcggccggccgtcttcccggcccccgggggcggggcggcggggcccccgccccaaggaggaagcccccctccaaaaaaaccggaattccaaccttgattgatccaaaaaagtggccccagcaagcgccgcggtttcccccactaattaagggggggggggggggggtttacaccagcctttcgggtttaaaggaggggcccagggacccttttccgaagggggtcccccc

SEQ ID NO: 39120 - DNA, 628 bp, Zea mays
  misc_feature: Ceres CLONE 1428746-F
  misc_feature: Encodes the peptide sequence at SEQ ID NO. 39121
  misc_feature (321)..(321): n is a, c, t, g, unknown, or other
  misc_feature (423)..(423): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (451)..(451): n is a, c, t, g, unknown, or other
  misc_feature (452)..(452): n is a, c, t, g, unknown, or other
  misc_feature (467)..(467): n is a, c, t, g, unknown, or other
  misc_feature (472)..(472): n is a, c, t, g, unknown, or other
  misc_feature (504)..(504): n is a, c, t, g, unknown, or other
  misc_feature (510)..(510): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
aaagctggagctccccgcggtggcggccgctctagaactagtggatcccccgggctgcaggaattcgcacgagaccattacctagaacatcctaatcgaaaagaccttcaattcccctgcctgttgccgtacgtgcctaagctagcttcgtcgtctcgttgcacgtacgtagtagctagacagccgaatcggctctctagctagctcctcccttccgatcgatatcatcgccatgtcggggatctcgctggcggtggcgccaaggtccgacccggaccacgggtcggagcggcagccgacggcgatgctgggcggcgtgantggctcgctccgcgtcatcgagctgcagctggtggccttcatcatggtgttctcggcgtcgggcctcgtcccgctcatcgacctcgtgttcccccgtcgcanccacatctacnnntctcgcatctcccgnnctcgctttccggcgntggangccaataagtcgaccaagcctgatgacgccgntgggtnggccgcnnngctctccaagtcgtcccggaagatcttcgcggcagcaagctggtccaggtgtacgtgggtggtgggcacaaagtggggctggttcctgcccttggccacgtgctggggg

SEQ ID NO: 39121 - protein, 132 aa, Zea mays
  misc_feature: Ceres CLONE 1428746-F
  misc_feature (30)..(30): Xaa is any aa, unknown, or other
  misc_feature (64)..(64): Xaa is any aa, unknown, or other
  misc_feature (68)..(68): Xaa is any aa, unknown, or other
  misc_feature (74)..(74): Xaa is any aa, unknown, or other
  misc_feature (79)..(79): Xaa is any aa, unknown, or other
  misc_feature (80)..(80): Xaa is any aa, unknown, or other
  misc_feature (91)..(91): Xaa is any aa, unknown, or other
  misc_feature (93)..(93): Xaa is any aa, unknown, or other
  misc_feature (96)..(96): Xaa is any aa, unknown, or other
MSGISLAVAPRSDPDHGSERQPTAMLGGVXGSLRVIELQLVAFIMVFSASGLVPLIDLVFPRRXHIYXSRISRXRFPAXXANKSTKPDDAXGXAAXLSKSSRKIFAAASWSRCTWVVGTKWGWFLPLATCWG

SEQ ID NO: 39122 - DNA, 669 bp, Zea mays
  misc_feature: Ceres CLONE 1428747-F
  misc_feature: Encodes the peptide sequence at SEQ ID NO. 39123
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaatcttactggcgcccaagctctccacgccagccatctcccctccatcttcccttctgcagaaatcctaccatggccgccctccctggtgctcaccccagtcgaggtctctccatggccggctgtagttccctggcgcccctgctcctccctgttctagctcggtgctcagagccccagcgccagtcgcccttctgctcccttccccatggcgcgcttgctccctagacggcgctcggattcctccttctcggccctctccatcgcgccctgctcgcccagccgcgccgagctcggcctcttcttctcccctgctcctatggcggcgccggtcggatctccctggcgcctcaccctgctctctatctgcccatgaagtcgcctagcccaaccgtgcctgctccctcactgtgctcgccatggtcgccgcctccaagcttctccctgctgcgcctgtggccgtcccctctgctcgccacgacgtgtcgagctcccgcgtcgagtccttttcctgctcgcccgcgatgcccggcgtcctgcctgctctgctcgccatccgtccatgcgtn

SEQ ID NO: 39123 - protein, 50 aa, Zea mays
  misc_feature: Ceres CLONE 1428747-F
MVAASKLLPAAPVAVPSARHDVSSSRVESFSCSPAMPGVLPALLAIRPCV

SEQ ID NO: 39124 - DNA, 631 bp, Zea mays
  misc_feature: Ceres CLONE 1428749-F
  misc_feature: SWISSPROT Homolog: EC 3.6.3.14 H(+)-transporting two-sector ATPase
  misc_feature (215)..(215): n is a, c, t, g, unknown, or other
  misc_feature (238)..(238): n is a, c, t, g, unknown, or other
  misc_feature (239)..(239): n is a, c, t, g, unknown, or other
  misc_feature (281)..(281): n is a, c, t, g, unknown, or other
  misc_feature (288)..(288): n is a, c, t, g, unknown, or other
  misc_feature (526)..(526): n is a, c, t, g, unknown, or other
caaagctggagctccccgcggtggcggccgcttctagaactagtggatcccccgggctgcaggatttcgcacgagaccattacctagaacatcctaattgaaaaacgcgctcttcagatcagatcggcaaggccaatcccgagcagtggtgcgaaacctcgagcgctcgcgccggtgacccatacaaagaggaagcccgcgtagcactggtagcngcagcagtaagggggagatgtcnntcgcgtttcagcgcgaatgaaacggcccctttctttcgcttncttggcngcttcgctggctcggcctctcatggatgggggccgcgtaccggaaaacccaaagtggcgtccccctggcctccattgggttaatgcccccaaaatcctcatgaagtccatcgggcccgggccttgggtggggtggtcccgaaataaaggcttcatcatttgccgtcttcattgggactggggttaaccccaagggggaacccttaatactctttttaagggtttttcccccccttttnccgggcccttcccgtgggcctttttggggttttttccagcattggccattttaaaccttgggggaaacttgggggaagggggaaaaatctctccccccaaatttt

SEQ ID NO: 39125 - DNA, 671 bp, Zea mays
  misc_feature: Ceres CLONE 1428768-F
ggagctccccgcggtggcggccgctctagaactagtggatcccccgggctgcaggaattcgcacgagaccattacctagaacatcctaatcgaaaactcttccgcctccgattgagtggctcaccttctttcccagccagcacgagcttgcaagcaagcgagctcctgagatttcagctcgcttctcctccagaggtcgagcagaccagactcctccgaccgaagctctacccacttccagttagcctgtccaggaactgcttggccggagatccaaacaaacctctgtgtttggggttctccggggttccttgcgctggagggaggtttcgtctcgcctggccatggttggctgaaaagcagcagccgcagccatctgatgccggaatctctgaactttatgaagatcgccactcacctgcggcgctcctgcttccctcactccgtctcgggtgtcttcctctactggttttatgtgatctcataacttgcccctccccgggatcccgcattcccccgtgcccctctctccgtccccatcaaccttctcccctcttttcttgcttccctcaacaatcgccaataacagcactagcggcagcggaagaggatcttttcaaggtaagctagggccggccgggtccctggcggaaaaaaaaaagaaaaaggac

SEQ ID NO: 39126 - DNA, 708 bp, Zea mays
  misc_feature: Ceres CLONE 1428776-F
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
  misc_feature (51)..(51): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (59)..(59): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (99)..(99): n is a, c, t, g, unknown, or other
  misc_feature (100)..(100): n is a, c, t, g, unknown, or other
  misc_feature (169)..(169): n is a, c, t, g, unknown, or other
  misc_feature (191)..(191): n is a, c, t, g, unknown, or other
  misc_feature (228)..(228): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (268)..(268): n is a, c, t, g, unknown, or other
  misc_feature (270)..(270): n is a, c, t, g, unknown, or other
  misc_feature (279)..(279): n is a, c, t, g, unknown, or other
  misc_feature (283)..(283): n is a, c, t, g, unknown, or other
  misc_feature (290)..(290): n is a, c, t, g, unknown, or other
  misc_feature (302)..(302): n is a, c, t, g, unknown, or other
  misc_feature (312)..(312): n is a, c, t, g, unknown, or other
  misc_feature (319)..(319): n is a, c, t, g, unknown, or other
  misc_feature (331)..(331): n is a, c, t, g, unknown, or other
ggggnnnggggnnnnnnnnnnnnnnnnnnnnnnnnngnnnngnnngccgnnggnnnngngngnngnnngcnnnnnnncnnnnnnncnnnnccnnnnngnnggtgcaaaacctggggctcccccgcgggggcgggccgctctggaactagtggatcccccgggtctgganggaattcgcacggggacctttncccggagacccccagttcgatgatggctgctcgcccnccnnnnnnnnnnttcacaannnnnnnncccagagctgggngnctccaccgncggnggggcgnggccgctctagnaactagtggnatccccncgggctgcaggnaattcgcacgagaccattacctagaacatcctaatcgaaaaaaaaaggtccctctcctcgcgtctcgttgtccatctagcccatctgctctctcagcgaggacgaaggcacaaacccctcacctccctcaaccctagccctcgctctcccgctttgttcccgtcaccgccatcatggggctcagatgcggacatggagggactaccgggttcgagtactcctgaccaaaaacccgaagggagccgggatggccaccctttgggaacccggtttttaccacctcccaaggttttgggcaaaaacaaaaccccgggggggggcccttggcggggtttttaaccaaggggggccccttttggggccccttaaaaaggggt

SEQ ID NO: 39127 - DNA, 658 bp, Zea mays
  misc_feature: Ceres CLONE 1428777-F
  misc_feature: Encodes the peptide sequence at SEQ ID NO. 39128
  misc_feature (387)..(387): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccattacctagaacatcctaatcgaaaaatcacataagtccgccgcccctctccctcagtaaacccccctctcttcttcccgcggtctgctcgttcgatctgtgcagcagatctgaggtctcgagcgaccgtgaagcagcttcaatcgtcggcatggcgctcgtattgcatagtggggctggaaacaagaatgccttcaaagcacttattgctgcagaatacagtgggatcaaggttgagttgaccaagattttgagatgggtgtctccaaacagacccctgagtttcttaagatcaacccccgtggggagggnttcctgttctganactcctgatggccctgtttttgagaggtatgctatcgcacgctattgtgctccgctgaaggatgacaaccctctttttgggcctccccgaattgaaaagcccccgttgacgaatggatggattttgcccaacaaagtttgacctggggggtccatgggacttggaaccaagggtggggacccccccttagggccccacacctgggaaaaacccctttttcttcttttaaaaaggccccttggggcctctaaaacaacc

SEQ ID NO: 39128 - protein, 104 aa, Zea mays
  misc_feature: Ceres CLONE 1428777-F
  misc_feature: SWISSPROT Homolog: EC 2.5.1.18 Glutathione transferase
  misc_feature (54)..(54): Xaa is any aa, unknown, or other
  misc_feature (58)..(58): Xaa is any aa, unknown, or other
MALVLHSGAGNKNAFKALIAAEYSGIKVELTKILRWVSPNRPLSFLRSTPVGRXSCSXTPDGPVFERYAIARYCAPLKDDNPLFGPPRIEKPPLTNGWILPNKV

SEQ ID NO: 39129 - DNA, 759 bp, Zea mays
  misc_feature: Ceres CLONE 1428778-F
  misc_feature: Encodes the peptide sequence at SEQ ID NO. 39130
  misc_feature (369)..(369): n is a, c, t, g, unknown, or other
  misc_feature (451)..(451): n is a, c, t, g, unknown, or other
  misc_feature (454)..(454): n is a, c, t, g, unknown, or other
  misc_feature (455)..(455): n is a, c, t, g, unknown, or other
aaagctggagctccccgcggtggcggccgctctagaactagtggatcccccgggctgcaggaattcgcacgagaccattacctagaacatcctaatcgaaaaacgcgcccacctcctctgctctctcctctcccccacctctgcgtccgtgcgttgtgtttgtttaggcgacaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgcctttgtcggcaagctncgcgacgacgagttcggccgcatgctcgcccgcatccctcgcgacaacggcgtcgaacgacggcggcgtcgtcttcgactcnggnngcggcaccgggcttcgcctttgtcaccctgggcggcgacggggaacccccagtttcatgtttacccgaacccccagggttaaattggtcctcccgccaaaaaaattcaaggtcgaagtttttaagagggcttgggggtttcccaaggggataaaaacttttttttggaaaccttggggaaaaaaaattccccggcgcgggaaaattccaaaaaaggggggggccctcttttttattccccaccctgggggggggttttgtggccccccgggggagggcccccccccacatttgttaggttgggg

SEQ ID NO: 39130 - protein, 116 aa, Zea mays
  misc_feature: Ceres CLONE 1428778-F
  misc_feature: SWISSPROT Homolog: EC 2.7.1.4 Fructokinase
  misc_feature (89)..(89): Xaa is any aa, unknown, or other
  misc_feature (90)..(90): Xaa is any aa, unknown, or other
MAAGRELVVSFGEMLIDFVPTVAGVSLAEAPAFLKAPGGAPANVAIAVSRLGGGAAFVGKLRDDEFGRMLARIPRDNGVERRRRRLRLXXRHRASPLSPWAATGNPQFHVYPNPQG

SEQ ID NO: 39131 - DNA, 657 bp, Zea mays
  misc_feature: Ceres CLONE 1428779-F
  misc_feature: Encodes the peptide sequence at SEQ ID NO. 39132
aaagctggagctccccgcggtggcggccgctctagaactagtggatcccccgggctgcaggaattcgcacgagaccattacctagaacatcctaatcgaaaaatcacctcagtatttgtcagaagctcaaatactgatctcactgatccagtatggctatggcaaaggcaggcgcgccgagggtctcggcggcccagctggtgactctcgggctatcactcctctgcgctgtcgccggcccggccgccgcgcagaactgcggctgccagccaaacgtatgctgcagcaagtttggctactgcggcacgaccgacgagtactgcggcgacgggtgccagtcgggcccgtgccgctcgggcggcggcggcagcagtggcggcggtggtgcgaacgtggctagcgtcgtcaccggctccttcttcaacggcatcaagagccaggccgggagcgggtgcgagggcaagaacttctacaccccggagcgcgttcctgagcgccgtcaaggcgtaccccaggcttcgcccattggcggggccccagggggccagggcaaccccaaaaaattcccccccttttttttcccccccccccccccaaaaacggggttttttttttttcccgagaaaaaaaaaaaacccctttgccccccccaaaaag

SEQ ID NO: 39132 - protein, 168 aa, Zea mays
  misc_feature: Ceres CLONE 1428779-F
  misc_feature (33)..(66): Pfam Name: Chitin_bind_1 Pfam Description: Chitin recognition protein
  misc_feature: SWISSPROT Homolog: EC 3.2.1.14 Chitinase
MAMAKAGAPRVSAAQLVTLGLSLLCAVAGPAAAQNCGCQPNVCCSKFGYCGTTDEYCGDGCQSGPCRSGGGGSSGGGGANVASVVTGSFFNGIKSQAGSGCEGKNFYTPERVPERRQGVPQASPIGGAPGGQGNPKKFPPFFFPPPPPKTGFFFFPEKKKKPLCPPQK

SEQ ID NO: 39133 - DNA, 731 bp, Zea mays
  misc_feature: Ceres CLONE 1428781-F
  misc_feature: Encodes the peptide sequence at SEQ ID NO. 39134
  misc_feature (557)..(557): n is a, c, t, g, unknown, or other
  misc_feature (559)..(559): n is a, c, t, g, unknown, or other
  misc_feature (563)..(563): n is a, c, t, g, unknown, or other
  misc_feature (567)..(567): n is a, c, t, g, unknown, or other
aaagctggagctccccgcggtggcggccgctctagaactagtggatcccccgggctgcaggaattcgcacgagaccattacctagaacatcctaatcgaaaaactccgctaggttcagcagcggcaccagtcggctgagcggatctccggtgaggttgagggatcagggatggcgaacggcggcggctacgtgtgggcccttgcggcgggcttcaacgccgcgctcgccgccatctccgccaaattcatcgccactctgtggtttgcaggtgccagcctcatcattcttggcgtcttcatcctcagcaagtccagcatcgaggagaaacagaacacggattaggtggaaaagttttgaccgctagtgttagctgtaacatatacgtactccgcataagctgagccatgggatgttttgtccgtccatgtagccgaatcagagcatgactgtcatttcggctatacaatgtactgtagcaaacatgttgtgcgagttgtcacgccagaacatttgacatttcccatggggctactggtacatcgagaatcatcgctgnanttgnatgnatggggggggaatggatttcatttaatttagtaaaattctaatccaagcggttggcaagaaaaaaaaaaaaaaagcttatccgttcccgtcccacctcgggggggggccccggaacccaattccccctaaagggggggccaattaacccccctctcctgggccg

SEQ ID NO: 39134 - protein, 57 aa, Zea mays; identical to SEQ ID NO: 39008
  misc_feature: Ceres CLONE 1428781-F

SEQ ID NO: 39135 - DNA, 813 bp, Zea mays
  misc_feature: Ceres CLONE 1428782-F
  misc_feature: Encodes the peptide sequence at SEQ ID NO. 39136
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
tgtgtggggtgganngangtggtaagaaagtaggaagtaataagcccctcccctcaaaattggacctccccgcggtggcggccgctctagaactactggatcccccgggctgaaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcactcggggctagcggtggcggcgtgcctgaccctgcgcaacacgcgggcgctggtcctggaccgcgacgactgcttggagacactgtggaagaagccaaacttactaaccgcctccacattccacatcaccaaaaactcacctgcccgcctgccacaaagtgccaaaaccaaagaaaaaacccccccggggaacctgcaaccgacaaaggacttgacgaagggtgaaaaccaggcaaagggttgagtgccgggggcggggtggcgacatgcacgccccccggcccccaccacccgcacaaacacccgagcgcccgcccccgataactcaccccccgcccaccccccacaaaccaaaaaaaccggtgagcccccctgagaacacatcatacagcgcgggccaaagaccggagggcaaaaaacaggataaaagagcaaacactagaggggcgccggcggggcccacgacaaaaaccgctcaaaaaaaacaacgcggggagggaagaaaaaaa

SEQ ID NO: 39136 - protein, 96 aa, Zea mays
  misc_feature: Ceres CLONE 1428782-F
MAAVAEEEVIVVGAGHSGLAVAACLTLRNTRALVLDRDDCLETLWKKPNLLTASTFHITKNSPARLPQSAKTKEKTPPGNLQPTKDLTKGENQAKG

SEQ ID NO: 39137 - DNA, 669 bp, Zea mays
  misc_feature: Ceres CLONE 1428785-F
  misc_feature: Translation starting site: 193
  misc_feature (279)..(279): n is a, c, t, g, unknown, or other
  misc_feature (433)..(433): n is a, c, t, g, unknown, or other
  misc_feature (514)..(514): n is a, c, t, g, unknown, or other
aagctggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcancagcagcagaagcagggcgccatgatgacggcgctcaaggccgcgacggccgcgaccttcggcgggtcgatgctggtgctgtccgggctgatcctggccggcagcgtgatcgcgctcacggtggccacccccgtgctggtgatcttcagccgtngccttgggggccgggccgccatcgcgctggcgctcatgggcggccgggttcgtcacctccggcgggctcggcgtcgctgcngctgtccgtgttctcctggatgtacaagtacctgacgggcaagcacccgccgggcgccgaccagctggacacgccaaggcgaagctggcgtccaggcccgcgacataaggatgcagcacagcacgcatcgaccaggggcaggggtctgagagaaa

SEQ ID NO: 39138 - DNA, 721 bp, Zea mays
  misc_feature: Ceres CLONE 1428788-F
  misc_feature: Encodes the peptide sequence at SEQ ID NO. 39139
  misc_feature (687)..(687): n is a, c, t, g, unknown, or other
aagctggagctccccgcggtggcggccgctctagaactagtggatcccccgggctgcaggaattcgcacgagaccattacctagaacatcctaatcgaaaactcgccagtgcccaccccgccagccggcacgaagcgcggcgttaatatctcccctcccttccctcttctggtctccgccccgctccttgcctccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaaagcagagatgagctccacaggatgctgaacgaggatgagctacgtgatgctgtgctgcttgtttttgccacaagcaagatcttccaatgccatgaatgctgctgagatactgancagcttggatacactccctgcgcagcgacactgg

SEQ ID NO: 39139 - protein, 136 aa, Zea mays
  misc_feature: Ceres CLONE 1428788-F
  misc_feature (5)..(136): Pfam Name: Arf Pfam Description: ADP-ribosylation factor family
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVESRDELHRMLNEDELRDAVLLVFATSKIFQCHECC

SEQ ID NO: 39140 - DNA, 652 bp, Zea mays
  misc_feature: Ceres CLONE 1428789-F
  misc_feature: Encodes the peptide sequence at SEQ ID NO. 39141
ccccgcggtggcggccgctctagaactagtggatcccccgggctgcaggaattcgcacgagaccattacctagaacatcctaatcgaaaagttcggacttccgccgcgcttcgccctctcgctccagccgcttcacagcgccgccgctcgcctctccgactgccgcgagaatgccgttcaagaggttcgtggagatcgggcgcgtggcccttgtgaactacggcaaagactacggccgcctcgtcgtcatcgtcgatgtggtcgaccagaacagggcacttgtggacgcccctgatatggtcaggtgccagattaacttcaaacggctctcacttaccgacatcaagattgacatcaaacgtgtccccaagaagtcaaccttgatcaaggctatggaggaagctgatgtgaagactaagtgggagaacagctcatggggcaagaagctgattgtccagaagaggagggctgcactcagtgactttgacaggttcaaggtcatgctggcaaggatcaagaggggtggtgctatcaggcaagagctctccaagctgaagaaggcgtccactgcttaagtcccttttggtggatgacattttcaaacttcatcaagaatgggtgtgctctggatattttgtcgggaatgatatgg

SEQ ID NO: 39141 - protein, 134 aa, Zea mays
  misc_feature: Ceres CLONE 1428789-F
  misc_feature (44)..(120): Pfam Name: Ribosomal_L14e Pfam Description: Ribosomal protein L14
MPFKRFVEIGRVALVNYGKDYGRLVVIVDVVDQNRALVDAPDMVRCQINFKRLSLTDIKIDIKRVPKKSTLIKAMEEADVKTKWENSSWGKKLIVQKRRAALSDFDRFKVMLARIKRGGAIRQELSKLKKASTA

SEQ ID NO: 39142 - DNA, 727 bp, Zea mays
  misc_feature: Ceres CLONE 1428800-F
  misc_feature: Encodes the peptide sequence at SEQ ID NO. 39143
  misc_feature (67)..(67): n is a, c, t, g, unknown, or other
  misc_feature (189)..(189): n is a, c, t, g, unknown, or other
  misc_feature (195)..(195): n is a, c, t, g, unknown, or other
  misc_feature (361)..(361): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (432)..(432): n is a, c, t, g, unknown, or other
  misc_feature (458)..(458): n is a, c, t, g, unknown, or other
  misc_feature (459)..(459): n is a, c, t, g, unknown, or other
  misc_feature (475)..(475): n is a, c, t, g, unknown, or other
  misc_feature (493)..(493): n is a, c, t, g, unknown, or other
atatctggagctccccgcggtggcggccgctctagaactagtggatcccccgggctgcaggaattcncacgagaccattacctagaacatcctaatcgaaaaattttcgaccgccgccgcccccagtccccgatccgaagctgtgcctcgtacccatttcgatccatggcgccgacgtcgaagctgtcnacgggnatcaagcgcgcttcgcggtcgcacacgtaccatcgccgggggctgtgggccctcagggccaaaaacggcgccccctcccccagggccaactatttccccgccggggggggaacccaatttcctccctgcttttttttttaagcccccgcttccccccccccccaantttttttttcccccccttccggggaaaagaaagggggnnnnnnnnnnnnnnnnnnnnnnnnnnnnnnnttnaaaaaaaaaaaaaaaaaaaatttttnngggggggggggggttntttttttttttttatttntgggatttgtaaataatggtggggttatattcccactacgcccccccacccactgcttccctcccctccccctcccgcgccggtaaacctggctgggtgatacccgcccccctgttgctcgccccaggtgttctgtccggcacacgaaaaggtctcagtcgcgctacgcctctggtagctgcaggctggtgcgtgacccccggcctcgcttccctgctcgggcccccccgcccc

SEQ ID NO: 39143 - protein, 56 aa, Zea mays
  misc_feature: Ceres CLONE 1428800-F
MAPTSKLSTGIKRASRSHTYHRRGLWALRAKNGAPSPRANYFPAGGGTQFPPCFFF

SEQ ID NO: 39144 - DNA, 673 bp, Zea mays
  misc_feature: Ceres CLONE 1428802-F
  misc_feature (294)..(294): n is a, c, t, g, unknown, or other
  misc_feature (317)..(317): n is a, c, t, g, unknown, or other
  misc_feature (337)..(337): n is a, c, t, g, unknown, or other
ggagctccccgcggtggcggccgctctagaactagtggatcccccgggctgcaggaattcgcacgagaccattacctagaacatcctaatcgaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcacccggcagactatcaccctcgaggtgggagtctctgacaccatttgacatggtcagggctagatccanggacaggagggcatccctcctgnacagcagcggcttatcttcnccggcagcagcttgagacggacgccacttgctgactacacatcaggaggagtcacccctcacctggtgctgcgcctaggggagctgcaaatcttggtcaaccttgacggggagaaatccccttgggggggccctcaccccttgacttggcaggggaaatccgggaaaggggggttcccctgggacgaagttttttttttttcggaaacctttggggggggggggcctttttgtactacaccccaggggggggccccccctgtggggggcccctgggggggggtccaatatttttaaaaaaccttggggggaacccctttttgggggggggggcccc

SEQ ID NO: 39145 - DNA, 756 bp, Zea mays
  misc_feature: Ceres CLONE 1428804-F
  misc_feature: Encodes the peptide sequence at SEQ ID NO. 39146
  misc_feature (756)..(756): n is a, c, t, g, unknown, or other
aaactggagctccccgcggtggcggccgctctagatctagtggatcccccgggctgcaggaatttgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgaccccgtcatggagcccgttgttgctggcagcaacacggtagtagctgttgcccaagttgagttgcaaacaatgaacgtgcaacaccccgctgatgttgccggacccagcgagggggtgggggcgatctccaaaggggggaaggtagggcccaacccgtgcacccccttgcaggaagaggggtgggactttcggggaattcaactgcccggtggggggaactttttactggggcacttccacccgcttcttcccaaaagagacggaatggcaaggtttccactttcccggactgttttcccaggggacccccctttgccaaggggttaataccgggggggggaaaggcaaan

SEQ ID NO: 39146 - protein, 170 aa, Zea mays
  misc_feature: Ceres CLONE 1428804-F
  misc_feature (14)..(38): Pfam Name: zf-A20 Pfam Description: A20-like zinc finger
MEHKEAGCQAPEGPILCINNCGFFGSAATMNMCSKCHKEMITKQDQAKLAASSIDSIVNGSDPVMEPVVAGSNTVVAVAQVELQTMNVQHPADVAGPSEGVGAISKGGKVGPNPCTPLQEEGWDFRGIQLPGGGNFLLGHFHPLLPKRDGMARFPLSRTVFPGDPPLPRG

SEQ ID NO: 39147 - DNA, 699 bp, Zea mays
  misc_feature: Ceres CLONE 1428808-F
  misc_feature: Encodes the peptide sequence at SEQ ID NO. 39148
  misc_feature (699)..(699): n is a, c, t, g, unknown, or other
aagctggagctccccgcggtggcggccgctctagaactagtggatcccccgggctgcaggaattcgcacgagaccattacctagaacatcctaatcgaaaaatctcatatcattcgtctgttctgtccttgatgtgctaaacgcgtgcatgcaggcgcgatctgcgggccggcgagcctggtgaacgcgatgatggacctgcaggagggggcgctgatgctgctgggccccacgatgaacgccaaggtggcgttcgagctgtcggagcggctgccacacctgccgctgcggatgcaggagcactcgcgccgcgcgctggcgttcgccgagcggatgcaggggctgggcctgcgcgtgctgtacccgggcctcccgggccacccgcaccacgcgcgcctggccgccatgggcaacccgggctacggctgcggcggcatgctgtgcctcgacatgggcaccgaggagcgcgccaaccgcctcatgcaccacctccagaaacacacccagttcggcctcatggccgtcagcctcggctactacgagacgctcatgtcctgctccggcagcagcaccagcagcgagatgccgcccgaggaccgcgcgcgcgcgggcatctccccgggcctcgtccgcatgtccgtcggctaacaacgcacgctggagcagcgctggccgccattcgagggcgcgctcgcgctn

SEQ ID NO: 39148 - protein, 152 aa, Zea mays
  misc_feature: Ceres CLONE 1428808-F
  misc_feature: SWISSPROT Homolog: EC 4.4.1.1 Cystathionine gamma-lyase
MMDLQEGALMLLGPTMNAKVAFELSERLPHLPLRMQEHSRRALAFAERMQGLGLRVLYPGLPGHPHHARLAAMGNPGYGCGGMLCLDMGTEERANRLMHHLQKHTQFGLMAVSLGYYETLMSCSGSSTSSEMPPEDRARAGISPGLVRMSVG

SEQ ID NO: 39149 - DNA, 732 bp, Zea mays
  misc_feature: Ceres CLONE 1428810-F
  misc_feature: Encodes the peptide sequence at SEQ ID NO. 39150
  misc_feature (252)..(252): n is a, c, t, g, unknown, or other
  misc_feature (258)..(258): n is a, c, t, g, unknown, or other
  misc_feature (267)..(267): n is a, c, t, g, unknown, or other
  misc_feature (268)..(268): n is a, c, t, g, unknown, or other
  misc_feature (395)..(395): n is a, c, t, g, unknown, or other
aagctggagctccccgcggtggcggccgctctagaactagtggatcccccgggctgcaggaattcgcacgagaccattacctagaacatcctaatcgaaaaagatcagatccccctttcgctggtttctttccccttggccaagcccaaaccgtctttaaatacacccgtcgtcgtccgcatcccccgcctgccttaaccattcctcccaacaccacctcgcctgcgatcttcgtagcctccggtcgcgtcngagcantcgatcatnngtcggcctactgcggaaagtacaaggatgagctcatcaagaatgctgcctacattggcacccccggcaagggtatccttgctgctgatgagtccactggcaccattggcaagccgctttccagcatncatgtcaagaacggtgaagaagaaccgccgtgccctccggggagctcctattctggctgccctggggctcctccagaaatcagccggggtgaatctttttcaagggaaaccttgttccaaaaaaaaaaaggatggcaagcctttttgtagatgtccccaaggagggagggcgcccctcctgggcctcaagggttgaaaagggcaccccttgggggtttgtggcccctaaaaaggaaaccccccccccgggggcttgaaacctctgggaaaagtgttcccaaaatataaaaagagggggggccccccttttttaaagggggcgccgttttctcaaaaa

SEQ ID NO: 39150 - protein, 180 aa, Zea mays
  misc_feature: Ceres CLONE 1428810-F
  misc_feature: SWISSPROT Homolog: EC 4.1.2.13 Fructose-bisphosphate aldolase
  misc_feature (84)..(84): Xaa is any aa, unknown, or other
  misc_feature (86)..(86): Xaa is any aa, unknown, or other
  misc_feature (89)..(89): Xaa is any aa, unknown, or other
  misc_feature (131)..(131): Xaa is any aa, unknown, or other
AGAPRGGGRSRTSGSPGLQEFARDHYLEHPNRKRSDPPFAGFFPLGQAQTVFKYTRRRPHPPPALTIPPNTTSPAIFVASGRVXAXDHXSAYCGKYKDELIKNAAYIGTPGKGILAADESTGTIGKPLSSXHVKNGEEEPPCPPGSSYSGCPGAPPEISRGESFSRETLFQKKKGWQAFL

SEQ ID NO: 39151 - DNA, 648 bp, Zea mays
  misc_feature: Ceres CLONE 1428811-F
  misc_feature: Encodes the peptide sequence at SEQ ID NO. 39152
aaaagctggagctccccgcggtggcggccgctctagaactagtggatcccccgggctgcaggaattcgcacgagaccattacctagaacatcctaatcgaaaaaggcacgacacgacacgagctcagccggcggcggcagagcgggaggagggagaacgcttcggtcccggtcccccccaacccaacctcctccccttcccgacaaggcgacgcgaagcgagatgccgctgtacgactgcatgctgctgctgaagacgacggtgaccagggaggtcctagcggaactggtgacgcgggtggcgcgccgcgcatgccagcgcaacggggtcgtcaccgacgtcaagtcattcggcaaggtcagcctcgcctacggcatcaggaagctcgacggccgccacttccagggccatcttatgcaaatgaccatgatggttcccccttcgttcccgcaagaactccactatctgaacaaggaggacaggctgcttcgctggctggtcgtgaagcacagagacacggtatacggggttggagttcttgaaccccgatgggcgggagggaccaagctaaaaattttcagccatgggccaccccaaaggccgactaccaatattaaaattgcccccccaatgaccaaagacctccaa

SEQ ID NO: 39152 - protein, 142 aa, Zea mays
  misc_feature: Ceres CLONE 1428811-F
  misc_feature (4)..(96): Pfam Name: Ribosomal_S6 Pfam Description: Ribosomal protein S6
MPLYDCMLLLKTTVTREVLAELVTRVARRACQRNGVVTDVKSFGKVSLAYGIRKLDGRHFQGHLMQMTMMVPPSFPQELHYLNKEDRLLRWLVVKHRDTVYGVGVLEPRWAGGTKLKIFSHGPPQRPTTNIKIAPPMTKDLQ

SEQ ID NO: 39153 - DNA, 672 bp, Zea mays
  misc_feature: Ceres CLONE 1428813-F
  misc_feature: Translation starting site: 210
  misc_feature: SWISSPROT Homolog: EC 5.3.3.2 Isopentenyl-diphosphate Delta-isomerase
  misc_feature (439)..(439): n is a, c, t, g, unknown, or other
  misc_feature (462)..(462): n is a, c, t, g, unknown, or other
  misc_feature (464)..(464): n is a, c, t, g, unknown, or other
  misc_feature (469)..(469): n is a, c, t, g, unknown, or other
aaagctggagctccccgcggtggcggccgctctagaactagtggatcccccgggctgcaggaattcgcacgagaccattacctagaacatcctaatcgaaaactgcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctactttcagcaaggtccgcgancaaggttacctttcctttagttngnaccantacctgctgcagccaccctctgtaccgtgagtctgagcttatccaggagactaccttggtgtgagaaatgcagcacagaagaagctactggatgagctgggcatcccagcagaagatgccccagttgaccaattcacccctctggggcgaatgctttacaagccacatctgacgggaaatggggggagcatgacctcgactcc

SEQ ID NO: 39154 - DNA, 640 bp, Zea mays
  misc_feature: Ceres CLONE 1428814-F
  misc_feature: Encodes the peptide sequence at SEQ ID NO. 39155
aaagctggagctccccgcggtggcggccgctctagaactagtggatcccccgggctgcaggaattcgcacgagaccattacatagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagcggctcggcaacagtgctgccagcagcagattaggatgatggacgtgcagtccgtcccgcagcacctgcaaattataatgcaacttgagcgtgcccttgccccccaaaaaaaccttttacaaacccctcttaatgcacaacaaaaaaacttgttggaaccccagggttccaacccccgtgcccttattaatggggcaaaaattccggcccagggggggacccccccaccccc

SEQ ID NO: 39155 - protein, 93 aa, Zea mays
  misc_feature: Ceres CLONE 1428814-F
MKMVIVLVVCLALSAASASAMQMPCPCAGLQGLYGAGAGLTTMMGAGGLYPYAEYLRQPQCSPLAAAPYYAGCGQPSAMFQRLGNSAASSRLG

SEQ ID NO: 39156 - DNA, 650 bp, Zea mays
  misc_feature: Ceres CLONE 1428816-F
  misc_feature: Encodes the peptide sequence at SEQ ID NO. 39157
aaagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgc

SEQ ID NO: 39157 - protein, 108 aa, Zea mays; identical to SEQ ID NO: 16131
  misc_feature: Ceres CLONE 1428816-F

SEQ ID NO: 39158 - DNA, 644 bp, Zea mays
  misc_feature: Ceres CLONE 1428817-F
  misc_feature: Encodes the peptide sequence at SEQ ID NO. 39159
aaagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagc

SEQ ID NO: 39159 - protein, 108 aa, Zea mays; identical to SEQ ID NO: 16131
  misc_feature: Ceres CLONE 1428817-F

SEQ ID NO: 39160 - DNA, 674 bp, Zea mays
  misc_feature: Ceres CLONE 1428828-F
  misc_feature: Encodes the peptide sequence at SEQ ID NO. 39161
  misc_feature (294)..(294): n is a, c, t, g, unknown, or other
  misc_feature (371)..(371): n is a, c, t, g, unknown, or other
  misc_feature (412)..(412): n is a, c, t, g, unknown, or other
aagctggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctcccggcagcagcaacccccagcgccggcggcagatgctgacccgggagccgtcggcgacaagctcgtcttcgaagcgcgcctcagcccgtgaggggagactacgntcagaacgccgtcaagtttctctcccaccccaggtcaggggctcccccgtcgtctacaggcgatccttccttcgagngaagggccttagcaccgaggagatcgacgaggccttccgangggttcctgaatcctcacccagcactacggctaccacttctccgcagcagcaggtcaacagccagaatcaatccggtcggggtgcaagcttatgccccagcacaaacctgtgcacccaagaaaacgctggccctgtcttccttccaacgcagcccagggtttagctgggtacaaagcattcctggctgcagggctcttgctttgtttttggggctagcccctcctgtcttaatcaaaaaaactgttctttcctaggctcaag

SEQ ID NO: 39161 - protein, 117 aa, Zea mays
  misc_feature: Ceres CLONE 1428828-F
  misc_feature (50)..(50): Xaa is any aa, unknown, or other
  misc_feature (64)..(64): Xaa is any aa, unknown, or other
MLTREPSATSSSSKRASAREGRLRSERRQVSLPPQVRGSPVVYRRSFLRXKGLSTEEIDEAFRXVPESSPSTTATTSPQQQVNSQNQSGRGASLCPSTNLCTQENAGPVFLPTQPRV

SEQ ID NO: 39162 - DNA, 715 bp, Zea mays
  misc_feature: Ceres CLONE 1428830-F
  misc_feature: Encodes the peptide sequence at SEQ ID NO. 39163
aagctggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattcggaaaacttcacggtcgagaactctgttctgttcgctggtccg

SEQ ID NO: 39163 - protein, 159 aa, Zea mays; identical to SEQ ID NO: 36910
  misc_feature: Ceres CLONE 1428830-F
  misc_feature (58)..(159): Pfam Name: PAP_fibrillin Pfam Description: PAP_fibrillin

SEQ ID NO: 39164 - DNA, 710 bp, Zea mays
  misc_feature: Ceres CLONE 1428837-F
  misc_feature (373)..(373): n is a, c, t, g, unknown, or other
  misc_feature (386)..(386): n is a, c, t, g, unknown, or other
  misc_feature (387)..(387): n is a, c, t, g, unknown, or other
  misc_feature (520)..(520): n is a, c, t, g, unknown, or other
aaagctggagctccccgcggtggcggccgctctagaactagtggatcccccgggctgcaggaattcgcacgagaccattacctagaacatcctaatcgaaaaacctataatattttgagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaccnaattgcccaattnngcacaacatccttggcacatctaacaatacaaaccatcgcaacgcaacagcaaacacagttcctaccagcactgagcccactagccatgggtgaaccctgtcggctaactgcaacagcagctgcttgcatccnacccacttgctctagcaaacgtagttgcaaaccagcaacaacaacactggaacagttttctgcagcgcttaagccaatagccatggggaaaccctggccccttacttaaaaaagaaaaaaattggtttttatttaacccgttccttgggggcaagggccccacttcctggaaaaaaaattgttgccaaaa

SEQ ID NO: 39165 - DNA, 696 bp, Zea mays
  misc_feature: Ceres CLONE 1428838-F
  misc_feature: Encodes the peptide sequence at SEQ ID NO. 39166
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (23)..(23): n is a, c, t, g, unknown, or other
  misc_feature (24)..(24): n is a, c, t, g, unknown, or other
  misc_feature (28)..(28): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (696)..(696): n is a, c, t, g, unknown, or other
nnggggnnnnnnnnnnnnccccnncccnnggccggcgnncgnnnattccttttttttcaaactgggactccccgcggtggcggccgctctagaactagtggatcccccgggctgcaggaattcgcacgagaccattacctagaacatcctaatcgaaaaacgtcgcgcccaaaaccgccgaccaaggctcgcacacgccgtggccgccccgcgcgctcgcccgccgcgtcgtccctgtccctgatccatccccagtccccagcaggccagcggccacctcccgctcgccgccgcttgtggccggaggaccggaggtacatgggccaggctctgcgccgcgcctcggggcgcgtgaagccccctcccgcgccctcgccgcccgcgaggcaaccccaccctcccccgcctccgccccaggcgtcgccggcgcccgctggcggcgcgacgcaggaccggctcgacgggctatctggtgacgatatcacggctccaacagaacacggtcatggtgtacttgaggaacgtgatccaagttacgacgagatgctcaagcacatggttggggagaatcactaccaagcccggaggaaaaccagaaatgggtgaagcttccgttgtccagcggtacaaccaggccgctcccaaaggtcagaaccgtcaaagggccgaacctggggaaaggtggggggaaagggn

SEQ ID NO: 39166 - protein, 95 aa, Zea mays
  misc_feature: Ceres CLONE 1428838-F
MGQALRRASGRVKPPPAPSPPARQPHPPPPPPQASPAPAGGATQDRLDGLSGDDITAPTEHGHGVLEERDPSYDEMLKHMVGENHYQARRKTRNG

SEQ ID NO: 39167 - DNA, 655 bp, Zea mays
  misc_feature: Ceres CLONE 1428841-F
  misc_feature: Translation starting site: 216
  misc_feature (365)..(365): n is a, c, t, g, unknown, or other
tccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttgaanaccttcttcagtgagactggcgctgggaagcacgcgccccccccctgtttttgttgaccttgagcccactgtcatcgatgaggtgaggactggcacctaccggcaggtcttccatcctgagcagctcatcagtggcaaggaggatgcagccaacaaccttccctcgggggtcactacaccattggcaaggagatttgttgacctggtgccttgaccgccatcaggaaagcctggcaaaataaatggcactgggtcctcccagggccttcccctcgactttcaacgggtgg

SEQ ID NO: 39168 - DNA, 686 bp, Zea mays
  misc_feature: Ceres CLONE 1428843-F
  misc_feature: Translation starting site: 292
  misc_feature (264)..(264): n is a, c, t, g, unknown, or other
  misc_feature (267)..(267): n is a, c, t, g, unknown, or other
  misc_feature (342)..(342): n is a, c, t, g, unknown, or other
  misc_feature (360)..(360): n is a, c, t, g, unknown, or other
aagctggagctccccgcggtggcggccgctctagaactagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcgggcgcccacgccacctacgggcagcancancagcagggaagaggccggcgcccaatgggtgagcaggtgaagggcatgctccacgacaaggggccgacggcgtcncaggcgctgacggtggcnaaccttgtcccgctgggcgggctgctgctggtgctttccgggctggccctaacagcctccgtggtgggctggccctggccacccccgtgttcctgatctccagccccgtgctgttcccccccccgctgctcatggggacggccgtcatgggttcctcacatcgggcgccctggggctcgggggcctttcctcgctcaagtgccccgaccaaaaggggggggaaggcgttccaccccccccccgaattccttggaggaggcgcaccccaagatggcgaaaggcccccgccccacccgggcccaaaaaacccccgaagggaggcccag

SEQ ID NO: 39169 - DNA, 649 bp, Zea mays
  misc_feature: Ceres CLONE 1428846-F
  misc_feature: Encodes the peptide sequence at SEQ ID NO. 39170
ctccccgcggtggcggccgctctagaactagtggatcccccgggctgcaggaattcgcacgagaccattacctagaacatcctaatcaaaaaagcaatagcatacgccctacgccttctttcctccctgcccccaccacgaaactccacgacgacgcgtccgcgcacctggcaggcacgaccaccgtggaccgtggtaccgtccatgccgagcaacgcgaggagttgagccgatggaggtggcgtcgggggacgaggatctggaatcgctgctccagaacttccatcgcgtgtcccaggggtacaaagatgcacttatgcaggtccaggttttaagagtaaattgcagcactgagttcaaaaggcgggaagctcttgaatcacatattacagatcttaagaaagataatgagcggttaagaaggcaatacacagaaactttattcaaggtcaccaaccaggtgaaattccacacagaagctcaaagccctgaaggaagagctggacaaggcaaatagtagattgttatccatgggaagaggaacacaagagggaaaactgagcaactttaagcaccgcaattgaaatgaacaatcaatgcccctgggagaacaaactccagcccacgccccttgtacaagcaaggcaag

SEQ ID NO: 39170 - protein, 94 aa, Zea mays
  misc_feature: Ceres CLONE 1428846-F
MEVASGDEDLESLLQNFHRVSQGYKDALMQVQVLRVNCSTEFKRREALESHITDLKKDNERLRRQYTETLFKVTNQVKFHTEAQSPEGRAGQGK

SEQ ID NO: 39171 - DNA, 637 bp, Zea mays
  misc_feature: Ceres CLONE 1428849-F
  misc_feature: Encodes the peptide sequence at SEQ ID NO. 39172
aaagctggagctccccgcggtggcggccgctctagaactagtggatcccccgggctgcaggaattcgcacgagaccattacctagaacatcctaatcgaaaagtaaaaatcaaatccaagacaaaacagacgatgagcttcactacatctctcatctcctctctggcttctcctccgtctctcgtccctccccacgatcttcctcctttcttctccctcagaaacacagtcctgaagccaacaatcgccactcgtacacgtcgacaactgttcccatcctcttgtctggctgcaaaagcagccacgtcgccgtcggagacagccaacgacgttgtcctcgaaacagctccgacaccagcgcatgaggtcgtctccagcttctacgccgccatcaacgtccatgacttatcctccgtcacagacctcatagctcaggactgcctctacgaggatctcgtcttctcttcccctttcgttggccgaacggcgattctggacttcttcgggaagttcatcgaagcaacgagtacggatcttcagttcgtgatagatgacatttccaaagaggactcttcagctgttggcgtttcatggcatttagaatggaaaggcaagaacttccccggttaggaaaggt

SEQ ID NO: 39172 - protein, 165 aa, Zea mays
  misc_feature: Ceres CLONE 1428849-F
  misc_feature: SWISSPROT Homolog: EC 5.3.3.1 Steroid Delta-isomerase
MSFTTSLISSLASPPSLVPPHDLPPFFSLRNTVLKPTIATRTRRQLFPSSCLAAKAATSPSETANDVVLETAPTPAHEVVSSFYAAINVHDLSSVTDLIAQDCLYEDLVFSSPFVGRTAILDFFGKFIEATSTDLQFVIDDISKEDSSAVGVSWHLEWKGKNFPG

SEQ ID NO: 39173 - DNA, 759 bp, Zea mays
  misc_feature: Ceres CLONE 1428858-F
  misc_feature: Encodes the peptide sequence at SEQ ID NO. 39174
ggagctccccgcggtggcggccgctctagaactagtggatcccccgggctgcaggaattcgcacgagaccattacctaaaacatcctaatcaaaaacatcaacgatattattgagaccaacaagcaacatagaaagtggaatctattatcaacggcgcagagaacagtggcgaccaagatattttccctccttatgctccttgctctttctgcatgtgttgctaacacgactattttccctcaatgctcaaaaactactatagcttcccttcttcccccataccttccatcaatgatagcttcagtatgagaaaacccacctcttcaaccctataagctcctacaagcaatcgtgacaagcaacatacctttatgccccttggttcaacaatcggcagacctatctttgctgcagtctttggtacaaaccatcagggcacagcagctgcatcagctcgtgctaccagtgatcaaccggattgctcaggcaaaccttgatcggtactctcagcaacaacagtttcttacattccaacaactggtataaattgaagcagagctggcttaatttgtagcaagcaataataaccatctcaaccaggctaggcttctggcaacctctacacggaacaatgggttttttcctattttaaccaacttgggcgaaaattaaacccccttgtgttttattttggaaggagccaaaacccctacgtatcgttttttaggcctgagcttcccccccacacagggtatttg

SEQ ID NO: 39174 - protein, 38 aa, Zea mays
  misc_feature: Ceres CLONE 1428858-F
MLLALSACVANTTIFPQCSKTTIASLLPPYLPSMIASV

SEQ ID NO: 39175 - DNA, 706 bp, Zea mays
  misc_feature: Ceres CLONE 1428859-F
  misc_feature: Encodes the peptide sequence at SEQ ID NO. 39176
  misc_feature (50)..(50): n is a, c, t, g, unknown, or other
  misc_feature (59)..(59): n is a, c, t, g, unknown, or other
  misc_feature (67)..(67): n is a, c, t, g, unknown, or other
  misc_feature (68)..(68): n is a, c, t, g, unknown, or other
  misc_feature (385)..(385): n is a, c, t, g, unknown, or other
  misc_feature (421)..(421): n is a, c, t, g, unknown, or other
  misc_feature (441)..(441): n is a, c, t, g, unknown, or other
  misc_feature (451)..(451): n is a, c, t, g, unknown, or other
aagctggagctccccgcggtggcggccgctctagaatagtggatcccccngggctgcanggaatttnnttccgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggncggctgctgctggtgctgtcggggctggcgctgacngccctccgtgtggggctggnccgtgccacnccggtgttcctgatcttcagccccgtgctcgtccccgcgcgctgctcatcgggacggccgtcatgggggttcctcacctcggccgccctgggggctccgggggcctgtccttccttcacgtggcttcccaaaaccgggcggggaggggttcccaagcccacccccgaactacgtggaaggaaggccccaccccaagaataggggaaaggcccccggcccccaccgggcccaaaaaaaaccccccaagggggggcc

SEQ ID NO: 39176 - protein, 146 aa, Zea mays
  misc_feature: Ceres CLONE 1428859-F
  misc_feature (44)..(147): Pfam Name: Oleosin Pfam Description: Oleosin
  misc_feature (77)..(77): Xaa is any aa, unknown, or other
MADRDRSGIYGGAHATYGQQQQQGGGGRPMGEQVKGMLHDKGPTASQALTVVTLFPLGRLLLVLSGLALTALRVGLXRATPVFLIFSPVLVPARCSSGRPSWGFLTSAALGAPGACPSFTWLPKTGRGGVPKPTPELRGRKAPPQE

SEQ ID NO: 39177 - DNA, 590 bp, Zea mays
  misc_feature: Ceres CLONE 1428865-F
  misc_feature (208)..(208): n is a, c, t, g, unknown, or other
  misc_feature (209)..(209): n is a, c, t, g, unknown, or other
  misc_feature (219)..(219): n is a, c, t, g, unknown, or other
  misc_feature (220)..(220): n is a, c, t, g, unknown, or other
  misc_feature (456)..(456): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (479)..(479): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtggttcgtctacnnggcagcctgnnatggcggccaagggtgtcccgcaacaatccttaaaagggggtttccggcccgggggccccggggctctttttttaaaaaaataccacccgggttttaaaaataagggggggggtttttttcccgcggagaatttccctccctttttaaaaaaaaaaaaaaaaaattgggggggggggggataaatagggggcgcccccaaaaaagagagaaggagcccccccccctttctctttgngnnnnnnnggggggaggcgagcngccccccccccacaaaaccaacaaaaaatttannnnnnngtatttttggtttgggtggnnnntnnaaaaaaacaaaaaaaaaagggggtgtttttgttttttctggggggg

SEQ ID NO: 39178 - DNA, 665 bp, Zea mays
  misc_feature: Ceres CLONE 1428867-F
  misc_feature: Encodes the peptide sequence at SEQ ID NO. 39179
  misc_feature (541)..(541): n is a, c, t, g, unknown, or other
  misc_feature (578)..(578): n is a, c, t, g, unknown, or other
  misc_feature (579)..(579): n is a, c, t, g, unknown, or other
  misc_feature (614)..(614): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgccctcatgagcatggagagggagatcatatngaaggcttttggtgctgaacttgtcctttactacccnnactctggaaatgaaagagctgtcaagaaagcgaangagatancagcaaagacacccaactcttacatcctttcacaatttgaaaat

SEQ ID NO: 39179 - protein, 153 aa, Zea mays
  misc_feature: Ceres CLONE 1428867-F
  misc_feature (12)..(153): Pfam Name: PALP Pfam Description: Pyridoxal-phosphate dependent enzyme
  misc_feature: SWISSPROT Homolog: EC 2.5.1.47 Cysteine synthase
  misc_feature (112)..(112): Xaa is any aa, unknown, or other
  misc_feature (125)..(125): Xaa is any aa, unknown, or other
  misc_feature (136)..(136): Xaa is any aa, unknown, or other
  misc_feature (139)..(139): Xaa is any aa, unknown, or other
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPALMSMEREIIXKAFGAELVLYYPXSGNERAVKKAXEIXAKTPNSYILSQFEN

SEQ ID NO: 39180 - DNA, 666 bp, Zea mays
  misc_feature: Ceres CLONE 1428870-F
  misc_feature: Encodes the peptide sequence at SEQ ID NO. 39181
  misc_feature (543)..(543): n is a, c, t, g, unknown, or other
  misc_feature (544)..(544): n is a, c, t, g, unknown, or other
aagctggagctccccgcggtggcggccgctctataactagtggatcccccgggctgcaggaattcgcacgagaccattacctagaacatcctaatcgaaaactcggtttcgggaaacctctcccccgttcccctcgaagcctacgggctcggggggcttcgatcgaatcgaatcggatcggatcggaagcatggagatctcgctcgaggcgtcgtgggtgggcgtgcagcggcacgggcaggacctggcggaccgcctcgcgcagggcttctcggggctcctcctccacgcgcagccgccgcagctgcccccatggtcgccggcggcgctgttgccgcccaagctcgtcatccccttcgacctcgacctccccgttgtccccttcgtcgccgggatgcgccgcggggtcgggaccgtggacctccccgccgtggccgtctcgtcgctcgtcgagatcggcggcaggctcgggcaggcggggtccgagctcggtgcggcggttcagcatctcgcgcgccaggtgcctgtgcctgtgcccttccnngaatgggaagcgcacagcccccgacccgtgtgacgggggaatgttgcgctcgctgttgggacggttgggtccgccaacgtccctttggaaaaggctgtaaacttggggccctcgagggggca

SEQ ID NO: 39181 - protein, 128 aa, Zea mays
  misc_feature: Ceres CLONE 1428870-F
  misc_feature (118)..(118): Xaa is any aa, unknown, or other
MEISLEASWVGVQRHGQDLADRLAQGFSGLLLHAQPPQLPPWSPAALLPPKLVIPFDLDLPVVPFVAGMRRGVGTVDLPAVAVSSLVEIGGRLGQAGSELGAAVQHLARQVPVPVPFXEWEAHSPRPV

SEQ ID NO: 39182 - DNA, 673 bp, Zea mays
  misc_feature: Ceres CLONE 1428890-F
  misc_feature: Encodes the peptide sequence at SEQ ID NO. 39183
aaagctggagctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaaggctgagcgtgagaggagtatcaccattgatattgctctgtggaagtttgagaccaccagtactactgcacggtcattgatgcccctggacaccgtgacttcatcaagaacatgatcactggtacctcccaggctgactgtgctgtccttatcattgacccccaccactgtgggttttgagcttggattcccaaggatggccaaacccgtgaacatgctcctcttgcttccacccttgaagtgaaccaaaaaatttgctgctccaacaaaatggattcaccccccccaaataccccagggcct

SEQ ID NO: 39183 - protein, 65 aa, Zea mays
  misc_feature: Ceres CLONE 1428890-F
MGKEKSHINIVVIGHVDSGKSTTTGHLIYKLGGIDKRVIERFEKEAAEMNKRSFKYAWVLDKLKG

SEQ ID NO: 39184 - DNA, 726 bp, Zea mays
  misc_feature: Ceres CLONE 1428894-F
  misc_feature: Encodes the peptide sequence at SEQ ID NO. 39185
  misc_feature (498)..(498): n is a, c, t, g, unknown, or other
  misc_feature (500)..(500): n is a, c, t, g, unknown, or other
  misc_feature (518)..(518): n is a, c, t, g, unknown, or other
aagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaaagaggaggtgagggagtatgagagcgacatgaggaagctggaggagctgcttttctagctgaaaccctcggcggaggagttcgtgccgcagtccccgccgcccgcgtggacgggcggcgctcccccgcctttcngncgaacgcgcccgtgtttnttgtcggccggggaatcgactactaaggggcgccaccacccagctcccggcggccgcagctttctgcagcagcaaccaagccgatgcaccctgcctccatttttggggggggggcctcccgccggggttttggcatttggtggggccgcccggggggaattaacaccccggcaagggaaggggatcccccccaaggggccacccccaa

SEQ ID NO: 39185 - protein, 60 aa, Zea mays
  misc_feature: Ceres CLONE 1428894-F
MVAVAVDGLIRGADAVPAAEREAVRAAAAEAAAKGGEGESGKEEVREYESDMRKLEELLF

SEQ ID NO: 39186 - DNA, 695 bp, Zea mays
  misc_feature: Ceres CLONE 1428896-F
  misc_feature: Encodes the peptide sequence at SEQ ID NO. 39187
aaagctggagctccccgcggtggcggccgctctagaactagtggatcccccgggctgcaggaattcgcacgagaccattacctagaacatcctaatcgaaaaagaagtggaaggaagcaggcggccaccatggtgaagggacgcacgggacagcgcgtcaggctctacgtccggggcaccatcctcggatacaagaggtccaagtcgaaccagtacgagaccacgtcgctcattcagatcgaggggggtgaacaccaaagaggacgtcgcgtggtacgctggcaagcgcatggcgtacattctacaggctaagaccaagagcagcgagacccgctacaggtgcatctggggcaaggtcacccgcccgcacggaaactcgggcgtcgtccgcgccaagttcaagtccaacctcccgcctgagtccatggggcgcaagtcagagtggtcatgtacccgagcagcatctaaggtttaggtttttgttggagtaaaggtggactctaaaatggccatgcttagttcttctctctaagcttaaaatgccatgtggttggcaacttaaattggtcatgttactgaaccctgtgaaagttctacccaaaattttgttttccaaacggcttaacagttgtccctaatgttatgctaaaaaacaagattttatttcccccccggtgccatcccctgtttgattt

SEQ ID NO: 39187 - protein, 61 aa, Zea mays
  misc_feature: Ceres CLONE 1428896-F
  misc_feature (2)..(53): Pfam Name: Ribosomal_L35Ae Pfam Description: Ribosomal protein L35Ae
MAYILQAKTKSSETRYRCIWGKVTRPHGNSGVVRAKFKSNLPPESMGRKSEWSCTRAASKV

SEQ ID NO: 39188 - DNA, 675 bp, Zea mays
  misc_feature: Ceres CLONE 1428897-F
  misc_feature: Encodes the peptide sequence at SEQ ID NO. 39189
  misc_feature (370)..(370): n is a, c, t, g, unknown, or other
  misc_feature (393)..(393): n is a, c, t, g, unknown, or other
  misc_feature (398)..(398): n is a, c, t, g, unknown, or other
  misc_feature (434)..(434): n is a, c, t, g, unknown, or other
  misc_feature (435)..(435): n is a, c, t, g, unknown, or other
  misc_feature (440)..(440): n is a, c, t, g, unknown, or other
  misc_feature (441)..(441): n is a, c, t, g, unknown, or other
aagctggagctccccgcggtggcggccgctctagaactagtggatcccccgggctgcaggaattcgcacgagaccattacctagaacatcctaatcgaaaaaaatagcaaatttctctagggggagcaggggctgagagagggctgcggagcaaggaatcaaggacgagccgccgagaggactagggtttagccatggcggccgaggaccagactccttgtaccaagctccgccccggcaaggcaaagacgcggaagaagacgaagagggacaagtggggccagcctatctccgccgccgccgccgatgaggagccgtcggtggagccggagcaagagcacccggcgggggtagttgaggcgcagtacanggtggagaaggaggaggaggaanaggcnactgcggcggcggaaggctatgagcccggggaggtnngtgcnnagcgcttgccctacacgaccacccgaggcgacatccggaagctgttcgagttctaccggcccatccagtcgatgcagctctctcgcttcccggactccgggcacttccgcggccttgccttcctctgcttcgaggtccatactccatagcaaccacacttccttcttcagaagagatgcaataaagtctcttgagcttgatggattcaaaattggcagcagatacatgagggtg

SEQ ID NO: 39189 - protein, 131 aa, Zea mays
  misc_feature: Ceres CLONE 1428897-F
  misc_feature (59)..(59): Xaa is any aa, unknown, or other
  misc_feature (67)..(67): Xaa is any aa, unknown, or other
  misc_feature (81)..(81): Xaa is any aa, unknown, or other
  misc_feature (83)..(83): Xaa is any aa, unknown, or other
MAAEDQTPCTKLRPGKAKTRKKTKRDKWGQPISAAAADEEPSVEPEQEHPAGVVEAQYXVEKEEEEXATAAAEGYEPGEVXAXRLPYTTTRGDIRKLFEFYRPIQSMQLSRFPDSGHFRGLAFLCFEVHTP

SEQ ID NO: 39190 - DNA, 687 bp, Zea mays
  misc_feature: Ceres CLONE 1428902-F
  misc_feature: Encodes the peptide sequence at SEQ ID NO. 39191
  misc_feature (496)..(496): n is a, c, t, g, unknown, or other
ggagctccccgcggtggcggccgctctagaactagtggatcccccgggctgcaggaattcgcacgagaccattacctagaacatcctaatcgaaaaaatatatcgaaaatctggacggcggcggactcgattgtagcagcagccgccgggaacaagatggcggcggcgttgtcgcagctggacgacgagatcgtccgcggcatggccatcggcgctgtcttcaccgactatgccgggaagataaactgcctcgatttccaccgcaaggaagatctcctcgtcacttccagcgaggacgactccatccgcatgtacaacatcaccagcgcgacgttgttaaagactacatatcacaggaaacatggtgctgaccgtgtctgttttagtcatcatccaagttctatcttatgctcttcacgatacaacctagagtctgcagatcacttcgttatctgtcattgtatgacaacccgtgcttagatacttcaaaggacancaagacagggtcgtttcatatgtatgtcgcctgtcaatgatagctttatgtcaggatcacttgatcacagtgtcagaatatggggatcctcccgtaaatgcttgtcagggcataccaaggctgcccggtaaactttctggtcccaattgaccaacggggacttgttttttccgtaacaatgggaagggggg

SEQ ID NO: 39191 - protein, 107 aa, Zea mays
  misc_feature: Ceres CLONE 1428902-F
MAAALSQLDDEIVRGMAIGAVFTDYAGKINCLDFHRKEDLLVTSSEDDSIRMYNITSATLLKTTYHRKHGADRVCFSHHPSSILCSSRYNLESADHFVICHCMTTRA

SEQ ID NO: 39192 - DNA, 690 bp, Zea mays
  misc_feature: Ceres CLONE 1428903-F
  misc_feature: Translation starting site: 173
  misc_feature: SWISSPROT Homolog: EC 1.14.11.13 Gibberellin 2-beta-dioxygenase
  misc_feature (313)..(313): n is a, c, t, g, unknown, or other
  misc_feature (368)..(368): n is a, c, t, g, unknown, or other
  misc_feature (395)..(395): n is a, c, t, g, unknown, or other
  misc_feature (397)..(397): n is a, c, t, g, unknown, or other
  misc_feature (690)..(690): n is a, c, t, g, unknown, or other
aagctggagctccccgcggtggcggccgctctagaactagtggatcccccgggctgcaggaattcgcacgagaccattacctagaacatcctaatcgaaaagcgctctgtgcacagacgaccttcttcccatcccttcccttccctctgctagtctgcttcgttcctcggccatggtggtcctcgccaagggtgagctcgagcagatcgccctcccggctgcagagccgcccccggccgacgtgcggtcggtggacctgtccgccccggcgggccccgcgcgcgaggccgcggcgcgcgcgctggtggcggcntgcaaggagcacgggttcttccgggtgacggggcacggcgtgccggccagactcntgcgcgccgcggaagccggcggcgccngntttcttcgcgccgccacagggcgagaaggaggaggagggccccacgctcgggtacggaaacaagcgcatcggcggcaacggggaacctcggctgggtcgagtacctcctgctcgggggaacacccgccgccgccggggtcctccttgggaattattgccctgccgccgcgcccccgtccccctccggcgccgggcggggcctttaacggacctttttggacaaatacaccggggccggtccggcaaatggccttcccccgttcttgaacttaaagggcgaaggggcttgggcn

SEQ ID NO: 39193 - DNA, 675 bp, Zea mays
  misc_feature: Ceres CLONE 1428909-F
  misc_feature: Encodes the peptide sequence at SEQ ID NO. 39194
  misc_feature (286)..(286): n is a, c, t, g, unknown, or other
  misc_feature (322)..(322): n is a, c, t, g, unknown, or other
  misc_feature (346)..(346): n is a, c, t, g, unknown, or other
  misc_feature (399)..(399): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaagaaggcggncgcccgatgggtgagcaggttgaagggcatgctccnacaacaaggggccgaacggcgtcncaggccctgacggttggtgacccttcttcccccctgggcggggctggcttgcnntggttcctttccgggccttggcccttaaacggcccccccccgggggtggggggctgggcccttgccccaccccccgggttttcctgaatttttaaccccggtgtttttcccccccggctttttttatgggaaggggcgtaaatggggttcccacagcgcggcgccccttggggcttgggggctttttccccctataagggcccccccaaaaaaggggggggggggtgtttcccccccccccccaaatacctggggaaagggcccccccccaggga

SEQ ID NO: 39194 - protein, 64 aa, Zea mays
  misc_feature: Ceres CLONE 1428909-F
  misc_feature (36)..(36): Xaa is any aa, unknown, or other
MGEQVEGHAPTTRGRTASQALTVGDPSSPLGGAGLXWFLSGPWPLNGPPPGVGGWALAPPPGFS

SEQ ID NO: 39195 - DNA, 729 bp, Zea mays
  misc_feature: Ceres CLONE 1428911-F
  misc_feature: Encodes the peptide sequence at SEQ ID NO. 39196
agagctggagctccccgcggtggcggccgctctagaactagtggatcccccgggctgcaggaattcgcacgagaccattacctagaacatcctaatcgaaaaatcaccaagttttggattccagcagcggcgcccccaggccaggccccacccgctcagcctcctcagctgcccaaccttctccccatctgctcagcctcagctgtcattcccgcgaagcgccgtctcccggctctatcgatggaccgagtcgccgccctcgtcgtcgcgctcctcgccctcttcttcgccgccggggccacggcgcaggccccggcctcgtcgcccaagcgcactccagcgccagcgccacccaggacggccttcctcccgccgccgccggccagggcgcctatggcctccccgccctcgcctcccgcgatggcgccggtgcccgcgccctccgccggcgtgccgtgcacgagccccgtcggcgcgggagctggtgacgacgcgatggcccccggcggagccgcggcggctctgactccggctgccgcgcccgtcacggagaagagcgccgccgttttagccttccgccgcgccgccaggctcgtggccatcgttggccgcgggggcagccgccgtccgcgttctaaaccgggaccgaccttgggacatccgaaatggccgggggatcccgtgaaggagctagacctgccctccttcccccgccggggggggtggggg

SEQ ID NO: 39196 - protein, 163 aa, Zea mays
  misc_feature: Ceres CLONE 1428911-F
MDRVAALVVALLALFFAAGATAQAPASSPKRTPAPAPPRTAFLPPPPARAPMASPPSPPAMAPVPAPSAGVPCTSPVGAGAGDDAMAPGGAAAALTPAAAPVTEKSAAVLAFRRAARLVAIVGRGGSRRPRSKPGPTLGHPKWPGDPVKELDLPSFPRRGGWG

SEQ ID NO: 39197 - DNA, 667 bp, Zea mays
  misc_feature: Ceres CLONE 1428915-F
  misc_feature: Encodes the peptide sequence at SEQ ID NO. 39198
aaagctggagctccccgcggtggcggccgctctagaactagtggatcccccgggctgcaggaattcgcacgagaccattacctagaacatcctaatcgaaaaatcagtcttttccaatcaatcaccagctcaaacttgtacccaaaaccctacaccggagggagagggatggtcaagaaagccgtctccaccgcgccagcagacgccgaggccgacgagcgccgccgcctccgctcgctcgccttctccaacggcctgctccagcgaggcgaccccgcggcgccgcgggcgccgctcgcgccggcggctgccgtcacgcgcctacagggccgcgacgtcgtccgccgtggcggccagcgaaagagccgctacctcttctccttccctggcctcctcgcgccagcagcctcgggtggccgggtcggagagctcgccgacctcgggaccaagaaccccctgctgtacctcgagttcccacagggaaagatgaagctcttcgggacgcacgttttaccccaagaaccagtacctcacccctgcaaatgaacaagtccggccaagggcctccctctgggaaggacgtctttgagagccttgaaggggttttcctaaaacctgggggggtggggaacaaaagaagataattcccgaaaaacctcaaactttg

SEQ ID NO: 39198 - protein, 125 aa, Zea mays
  misc_feature: Ceres CLONE 1428915-F
MVKKAVSTAPADAEADERRRLRSLAFSNGLLQRGDPAAPRAPLAPAAAVTRLQGRDVVRRGGQRKSRYLFSFPGLLAPAASGGRVGELADLGTKNPLLYLEFPQGKMKLFGTHVLPQEPVPHPCK

SEQ ID NO: 39199 - DNA, 735 bp, Zea mays
  misc_feature: Ceres CLONE 1428917-F
  misc_feature: Translation starting site: 194
  misc_feature (679)..(679): n is a, c, t, g, unknown, or other
aagctggagctccccgcggtggcggccgctctagaactagtggatcccccgggctgcaggaattcgcaagagaccattacctagaacatcctaatcgaaaagcactcatccattccatcatcccctttgcaagtatagtctctctgctaagcgaagcgaagcttcaagctagtctcggcggctctagaagacgatgggcaagaacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgtgcgtgctgggcatcgcctgggccttcggcggcatgatcttcgtcctcgtctactgcaccgccggcatctcggggggccacatcaaccccgccgtcacccttcggcctcttcctggcgcgcaaggtctcccttggtgcgcgcgctgctctacatcgtggcgcagtgcctcggcgccatctgcggcgtcggcctcgtcaaggcgttccagagcgcctacttccacaggaacgggcggnggggccaacttgttcgccttcgggttattccccgcgcaccggccctcgcccccaaa

SEQ ID NO: 39200 - DNA, 709 bp, Zea mays
  misc_feature: Ceres CLONE 1428922-F
  misc_feature (138)..(138): n is a, c, t, g, unknown, or other
  misc_feature (158)..(158): n is a, c, t, g, unknown, or other
  misc_feature (159)..(159): n is a, c, t, g, unknown, or other
  misc_feature (249)..(249): n is a, c, t, g, unknown, or other
aagctggagctccccgcggtggcggccgctctagaactagtggatcccccgggctgcaggaattcgcacgagaccattacctagaacatcctaatcgaaaactacaagattattttgaaatttcgacgagatttgtcnggaacaatggcgactccacnnttcagcagtggcgcagcaagccgccgccgccatttcgaaactcccgatcgccgaccgttgctttctttcccctcagcctcgccacttcanagagagagagagagagagaagagagagagagagagagagcttacgatggcgtccagagacgcggccagcagccccaaatcagcgccgcgtcgccatgggccggggcgcgcccaagaatggggccgacctgctcagcccacgggttccggtcggttgccccccctggccgggttgggacaaaggagtcccgtcctcccttgcccgcgatgggcgtttaaaaaaaccccccgttcggcgaatctcccgttgcaaaaagggggggccctcccccctccttccggggggggggggggcccgggtttcccccccccccaaaaaaagaggggcccccccagggggttttccccggcccaaaaatccccccccggggggtttttcccgcccccccaacacaaaaaaaccgcgaaccctcccgggcaaaaaaacaaaaacccaagaagggaagggccccccaaaggga

SEQ ID NO: 39201 - DNA, 680 bp, Zea mays
  misc_feature: Ceres CLONE 1428927-F
  misc_feature: Translation starting site: 458
  misc_feature (344)..(344): n is a, c, t, g, unknown, or other
  misc_feature (368)..(368): n is a, c, t, g, unknown, or other
tccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggtttacctgccacctccggtgcatctcccaccgccggtccacctgccngcgccggtccacctgccaccgccngtccatgtgccgccgccggtttcatctgcggcgccaccacccactaccctactaaacggcccgggctcagcctcatcccaggcccacccatgtccgtgccaacgcccattccagcccgggcagctgcagggaaccgcgggtttgcgacccccccatcctgggccggggctcaagtctccaagggataggtgaccccgaggggaaccccttatgtcccccccagggccaatttttggggaaaatggttttccccccctccaggggggggggccccccacccggcccgggaaatttggggtggcccccccaccc

SEQ ID NO: 39202 - DNA, 732 bp, Zea mays
  misc_feature: Ceres CLONE 1428932-F
  misc_feature: Encodes the peptide sequence at SEQ ID NO. 39203
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaaaaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttaacatagtgcaggagtatgtcaagtcgcactagatgtaacacgtttcagtaatactctacatttggatctgggcttaatattatgcttgcgtcttgggcttgctaggagattaggacaatttactancagagcccatgaggatatgagcaatttggaa

SEQ ID NO: 39203 - protein, 140 aa, Zea mays; identical to SEQ ID NO: 4593
  misc_feature: Ceres CLONE 1428932-F
  misc_feature (25)..(120): Pfam Name: Ribosomal_L7Ae Pfam Description: Ribosomal protein L7Ae/L30e/S12e/Gadd45 family

SEQ ID NO: 39204 - DNA, 777 bp, Zea mays
  misc_feature: Ceres CLONE 1428933-F
  misc_feature: Encodes the peptide sequence at SEQ ID NO. 39205
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (451)..(451): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (472)..(472): n is a, c, t, g, unknown, or other
  misc_feature (473)..(473): n is a, c, t, g, unknown, or other
  misc_feature (485)..(485): n is a, c, t, g, unknown, or other
  misc_feature (499)..(499): n is a, c, t, g, unknown, or other
  misc_feature (502)..(502): n is a, c, t, g, unknown, or other
  misc_feature (507)..(507): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (518)..(518): n is a, c, t, g, unknown, or other
  misc_feature (605)..(605): n is a, c, t, g, unknown, or other
  misc_feature (651)..(651): n is a, c, t, g, unknown, or other
ctccccgcggtggcggccgctctagaactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccgtccgcggcggcgtggttaatgacggcgcccgcgggacggcnnnncnnncnncccctgnnnnncccccgccntggccctnnnnccccccgctnnggctgccttccncccccccccccccnggnttttnccnnnnngatnccgtgttccgggtgcggggtccctcccctcgggcccccaagttccggccatgggcacggttccggctcccttcccggattttgccgnggcccggggtcgggcgggcgaccaaggtccgcccgggaaagggagntgcccaaaagaaccggccaggaaaacgggggcccccccccagggggaaaatcatagcacgcaccttttctgggcccaccaggggggtttcgccaccattaggggcccgttttcagaagaatcccct

SEQ ID NO: 39205 - protein, 185 aa, Zea mays
  misc_feature: Ceres CLONE 1428933-F
  misc_feature (68)..(68): Xaa is any aa, unknown, or other
  misc_feature (69)..(69): Xaa is any aa, unknown, or other
  misc_feature (70)..(70): Xaa is any aa, unknown, or other
  misc_feature (71)..(71): Xaa is any aa, unknown, or other
  misc_feature (73)..(73): Xaa is any aa, unknown, or other
  misc_feature (74)..(74): Xaa is any aa, unknown, or other
  misc_feature (80)..(80): Xaa is any aa, unknown, or other
  misc_feature (81)..(81): Xaa is any aa, unknown, or other
  misc_feature (85)..(85): Xaa is any aa, unknown, or other
  misc_feature (89)..(89): Xaa is any aa, unknown, or other
  misc_feature (96)..(96): Xaa is any aa, unknown, or other
  misc_feature (97)..(97): Xaa is any aa, unknown, or other
  misc_feature (98)..(98): Xaa is any aa, unknown, or other
  misc_feature (100)..(100): Xaa is any aa, unknown, or other
  misc_feature (129)..(129): Xaa is any aa, unknown, or other
  misc_feature (144)..(144): Xaa is any aa, unknown, or other
MDSLPRKRKGARAACSLAGSRHDAPAARKRTCREPKPRPEKKKPSSADEGSASVRGGVVNDGARGTAXXXXPXXPPPWPXXPPLXLPSXPPPPGFXXXDXVFRVRGPSPRAPKFRPWARFRLPSRILPXPGVGRATKVRPGKGXAQKNRPGKRGPPPRGKIIARTFSGPTRGVSPPLGARFQKNP

SEQ ID NO: 39206 - DNA, 728 bp, Zea mays
  misc_feature: Ceres CLONE 1428938-F
  misc_feature: Encodes the peptide sequence at SEQ ID NO. 39207
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaagcaccaccaccgtcactcaacacagcacaggcagctcgagagagagagagaaagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacgggcggcgtgcacgacggcaccggcgtcngtgctctgggagtggtgcaagggcgagaaccagagctggaagatccctgccgtggggtcccgaggccaactccgccgcggcccacgcgggaggcccgcacgccgtgc

SEQ ID NO: 39207 - protein, 189 aa, Zea mays
  misc_feature: Ceres CLONE 1428938-F
  misc_feature (154)..(154): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGRRARRHRRXCSGSGARARTRAGRSLPWGPEANSAAAHAGGPHAV

SEQ ID NO: 39208 - DNA, 697 bp, Zea mays
  misc_feature: Ceres CLONE 1428947-F
  misc_feature: Encodes the peptide sequence at SEQ ID NO. 39209
  misc_feature (682)..(682): n is a, c, t, g, unknown, or other
  misc_feature (697)..(697): n is a, c, t, g, unknown, or other
tccccgcggtggcggccgctctagaactagtggatcccccgggctgcaggaattcgcacgagaccattacctagaacatcctaatcgaaaaactgtcgtagtcctagatccgaccgcctcacgagctacattccctcgaggccggccttcctggtgtctcagcagcggcggcgcatggcgatggctgcggggcgtgggctcttggccctcttctcggtcgtcgtagtggctgggctcacctctgcggcgaatggtcctttcctgtccgatagcgtcttccagccgagcgccggatctacagggaggagcttactgcaggccaagaacagttgccccgtgaactttgagttccaaaactacacaatcatcacaagcaagtgcaaagggccaaagtttccagccggcccatgctgtgccgcactcaaggagttcgcgtgcccttactatacgtacctcaatgacgagagcaacgactgtgcatcgacaatgttcagctacatcaacctgtatggtaagtatccaccgggcctgttctccagcgagtgcaaagaaggcaagcaggggctctcttgcgcagatgtcctcgagagagacagtgccactgcaagcagtggtcatcacgctcaaatcagcttgcttgcgttgattacttgtctttgagtggtggggaaaataaaacccnttttttttttttccn

SEQ ID NO: 39209 - protein, 161 aa, Zea mays
  misc_feature: Ceres CLONE 1428947-F
MAMAAGRGLLALFSVVVVAGLTSAANGPFLSDSVFQPSAGSTGRSLLQAKNSCPVNFEFQNYTIITSKCKGPKFPAGPCCAALKEFACPYYTYLNDESNDCASTMFSYINLYGKYPPGLFSSECKEGKQGLSCADVLERDSATASSGHHAQISLLALITCL

SEQ ID NO: 39210 - DNA, 705 bp, Zea mays
  misc_feature: Ceres CLONE 1428949-F
  misc_feature: Encodes the peptide sequence at SEQ ID NO. 39211
aaagctggagctccccgcggtggcggccgctctagaactagtggatcccccgggctgcaggaattcgcacgagaccattacctagaacatcctaatcgaaaaaccagagagtcagagtgcggaggtgaacgtgacgtgacgctcctcctctataaaaggagacgcctgtgctgcagtgtgcacagcacagcccgtcgcgcgccgctgcgttgaggttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggctccggcggcggccacagcccgccccaccatagcaagccgcccaagcaccaccatggctagccgcccaattgcccgccgtgcacccctccgtacgtgcctcctacgcctcgcccgtctcctccttacgagccacattcgtccacgccgcttggagtaggggactcccgctcgtaggactcgactcattcgagagactcgtcccgcgcccaggattgaattggctgggcacgtagggtgagaacgcgaatcacctgggaagtagggccgttctacggtcggatctcaatcccacaagatttctgttagcctcatcaatttttat

SEQ ID NO: 39211 - protein, 70 aa, Zea mays
  misc_feature: Ceres CLONE 1428949-F
MATSTSVPVLLLLAAAAGLLLLPGSLAWQSSNCAPGAPGSGSPTWPSPGSGSGGGHSPPHHSKPPKHHHG

SEQ ID NO: 39212 - DNA, 835 bp, Zea mays
  misc_feature: Ceres CLONE 1428952-F
  misc_feature: Encodes the peptide sequence at SEQ ID NO. 39213
attgctcgcgttgcggtctcgcccggaggtttgtattggcaaacaaaacaaactgggactccccgcggtggcggccgctctatactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggcaccagcgggtggagaagccgccgcccgaggccgccgccatcggcgagaatgagatccgcatcaccactcaggggcctcgtccgcaactacgtcacctacgccacctccctcgtccaggaaaaacaggtgaaggaaattggtgttgaagggctatgggacaggctataaagcaaggcaatggctattcgcggagaatccataaagaaagaggaattcctgggtttgcttcaagaatacaagtaaccagtttctgcccagaattaacctaatggtatggggagccccattggaggaaaggaacttggaaccaattgggaaataaaatccgtcaagggttgcaaagggaaaccggatctcccttgggcccccgaaggtgagtaataccttgtattttcgcccgggggtagtccacgcctcctataaaactacgcatctgaatatcaagaagagaatatgggcaaaccatcacagaataatgaaa

SEQ ID NO: 39213 - protein, 39 aa, Zea mays
  misc_feature: Ceres CLONE 1428952-F
MRSASPLRGLVRNYVTYATSLVQEKQVKEIGVEGLWDRL

SEQ ID NO: 39214 - DNA, 722 bp, Zea mays
  misc_feature: Ceres CLONE 1428955-F
  misc_feature: Encodes the peptide sequence at SEQ ID NO. 39215
aaagctggagctccccgcggtggcggccgctctagaactagtggatcccccgggctgcaggaattcgcacgagaccattacctagaacatcctaatcgaaaaactaactcagcactcgggagtcccagctcatccccatccctgcccgtctccccggacggccactcgaccagaagcacgcgagcgagcggagaccgatcgaggccgacagccatgggcaagcaagcgatggcgctggcgctgctgtgcgccgtcctgctggcggcgacggcggacgccgcggcggcggcgtcttgcaacccgtcggcgctgagcgcgtgcgcgcccgcgttgttcggcagggcggtcacgctggggtgctgcgcgtcgctgcgcgcgcagcagccctgcctctgccagaacaagcgcgaccccgctaaccgcgcctacgtcaacggccccgccgcgcaacgcttcacccgcgcctgcggcctcacccatatgaagtgctgatggaccgagagcctgcatgcgctccgcccgccgctggagatgttgtagtatgcgcggctacatgtatgtactactactacgagtccacggcgggtccatggacatacatacgtgccgtctaaataaaaacgcggtcgcggcgagctcgatacccttgctccggcaaatcgtggtcatctacgatacctcgttcagcatgagtaacgctgtgcctggcgccggtgtgatct

SEQ ID NO: 39215 - protein, 92 aa, Zea mays
  misc_feature: Ceres CLONE 1428955-F
MGKQAMALALLCAVLLAATADAAAAASCNPSALSACAPALFGRAVTLGCCASLRAQQPCLCQNKRDPANRAYVNGPAAQRFTRACGLTHMKC

SEQ ID NO: 39216 - DNA, 737 bp, Zea mays
  misc_feature: Ceres CLONE 1428968-F
  misc_feature: Encodes the peptide sequence at SEQ ID NO. 39217
  misc_feature (454)..(454): n is a, c, t, g, unknown, or other
  misc_feature (455)..(455): n is a, c, t, g, unknown, or other
aagctggagctccccgcggtggcggccgctctagatactagtggatcccccgggctgcaggaattcgcacgagaccattacctagaacatcctaatcgaaaactctttccgttttccttcctcgtcgcggtcgtgggtcacttgccgccgcgccggcaacgtccccttcccatccccagccacgcataaatcaatcgatgcattggtccttggcacgacttgattcctgattccctctgctgttctccacccgctctctctctttcgcgtggcatttcttcctgccagcgacgaattggcgcgcgccgccgccgccgtctgcccaggcccttcgcccacccaccagggccatgaaggaaggtataccatatatattcatgcctcaagggagaagcctgaacatgtcagtcccatattttgtggtcgagagatatacagtgaaaaagtaacttgnngtaaaatttctatggttgatgctgagaggaagttgaatgcaaatgctctacaggaatatgaaccatcagcattttggttttgcaatctgaaagctgggaacctttgccacagtttgattatggatttgactacctgaagggggcaaatcccaattttattgacggcttttagaaccccgggccccctgggaatttttaatatttccaaaaatttgttccctggaggcccaaaaaccgattttaaaagagggtccaaggggttccaagaaaaccccaaatggt

SEQ ID NO: 39217 - protein, 41 aa, Zea mays
  misc_feature: Ceres CLONE 1428968-F
MVDAERKLNANALQEYEPSAFWFCNLKAGNLCHSLIMDLTT

SEQ ID NO: 39218 - DNA, 740 bp, Zea mays
  misc_feature: Ceres CLONE 1428969-F
  misc_feature: Encodes the peptide sequence at SEQ ID NO. 39219
aaagctggagctccccgcggtggcggccgctctagaactagtggatcccccgggctgcaggaattcgcacgagaccattacctagaacatcctaatcgaaaaacccttctcgctcggttgctcgggagctttccccttcctgttcctgaagcttccgacatccgaccgcctcctcctcctcgttctactcgccgccccttctagaatcatccagaggcgtgccggtgaagcgcgagagcggtgaggcatggcgatgcagacgggggtcgcgacctccaaggtcctcatcctcgtcggtgcagggatgacgggctcgatcctgctgcggaatggccgcttatctgatgtgttgggagaactccaggagattatgaagggtgtaaatcaagggaacttctcgggtccctatgacattgcacttattcaagctcagattcggaatttagcgcaagaagcagagatttgacattgtcaagccccattaccatcctgaatggcaaatctgactccggaagcgagttaatcctccctaatactggcaggcacccacttttgggagcaatgggttattgctacatgggggggggaagggtttggccccctccaaatgtcctggtttgtccccaaacccaaccttgggaaaatggttgttcaagaattgtcaaaacctttgggagcaagttttccttcccctttttgttggaaaaaaaaaagcccttccactccccccgggcgtgggg

SEQ ID NO: 39219 - protein, 72 aa, Zea mays
  misc_feature: Ceres CLONE 1428969-F
MAMQTGVATSKVLILVGAGMTGSILLRNGRLSDVLGELQEIMKGVNQGNFSGPYDIALIQAQIRNLAQEAEI

SEQ ID NO: 39220 - DNA, 681 bp, Zea mays
  misc_feature: Ceres CLONE 1428970-F
  misc_feature: Encodes the peptide sequence at SEQ ID NO. 39221
gctctagaattcgtggatcccccgggctgcaggaattctcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctcacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcagggtcatgctcgtcggcatcgtctccgtcttcttcggcaccggcatgtacgctgcgccgctctcggtcatgaaattggtgatccagacaag

SEQ ID NO: 39221 - protein, 159 aa, Zea mays
  misc_feature: Ceres CLONE 1428970-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRVMLVGIVSVFFGTGMYAAPLSVMKLVIQT

SEQ ID NO: 39222 - DNA, 740 bp, Zea mays
  misc_feature: Ceres CLONE 1428984-F
  misc_feature: Translation starting site: 243
  misc_feature: Pfam Name: ENOD93 Pfam Description: Early nodulin 93 ENOD93 protein
aaagctggagctccccgcggtggcggccgctctagaactagtggatcccccgggctgcaggaattcgcacgagaccattacctagaacatcctaatcgaaaaaatcaatcctcgctagctcgctcgctctccttacaactccagtgctggtcactgccactgccaggagatgtagctgctgcgtctcacaaaccctcttgctttgctgctgcgcctgcaagtctgcaacccctcacacagagatgtcgacgacggtgagccgtgcgtccctcgaccagaagctcgccctcgccgagggttgctcccgagaggcgaccctcgccggagccaacgccgcagcgggggcgactatcgcctccgacgatccccaccctgtccagtgtgcggatgctgccatgggacaaagccaatctcaacccctgcgtgggtatgtgccaggttactaatacgacgaagcctacacgctgaatccacgcccccaccccccccacctcggcgggccccctccatgttgccccacgaccatggaggcgctgggcccgctacccgggggtcctaccggcgtgaccctcttcaactcccgcgtcggccgcaccgcctgggccctaccggctcgggcgtctggtccaaaaaggagttcgcgctccccgaatatcgactccgaccacatcgtcccccctcttcgagggcaactccaccctcttctgggggggaagcgccccgggcggcaaccacctcgg

SEQ ID NO: 39223 - DNA, 726 bp, Zea mays
  misc_feature: Ceres CLONE 1428986-F
  misc_feature: Encodes the peptide sequence at SEQ ID NO. 39224
  misc_feature (708)..(708): n is a, c, t, g, unknown, or other
atagctggagctccccgcggtggcggccgctctagatctagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgaccagatcactggtcgggtggcggacgacgacgcatggggaagggtagtgtgggtgcatcatggtgggcgttcctcctgctcgccggcgtgctgctggtcatagcagccaccgccggggcggaagactgagtggccgaacgggaccgcaaggatgacctgcggcggagcaagcatgggtgcgagtggtactacggaaaggacaccccgcggaagacggaatgctagagcgagtgccgcgagcggcaccggcaagctgacgcgggcgaggacggctacagcggcttggacgcctacatctcccgctccaggaggggcgagtgccggctccagtgcctgcgccgccacgagggccaaccgtgggagacccaggaatgcatgaggcggtgccgccgccgcggattggtcgtcgacatggagaaagagtactgtcgcggcagcaagagcgcgggcaagtgcctggagaggtgctagcgccaccaccgcgggtactgttgggacaggcagcgctgcctgatggactgcagatnccggaaagcggcaggagg

SEQ ID NO: 39224 - protein, 31 aa, Zea mays
  misc_feature: Ceres CLONE 1428986-F
MGKGSVGASWWAFLLLAGVLLVIAATAGAED

SEQ ID NO: 39225 - DNA, 636 bp, Zea mays
  misc_feature: Ceres CLONE 1428987-F
  misc_feature: Encodes the peptide sequence at SEQ ID NO. 39226
gcggtggcggccgctctagatctcgtggatcccccgggctgcaggaattcgcacgagaccatacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaaggacacccccgccgaaagaaagggattggccaaaacccagttggcccccaagcggcaccaccaatttaacgggggagaaagggaaacggggtgtggaaccctactttcccctccccgggagggggaagggccggcccccatttccttgcccccccccgggggggcacccccggggggagaaacaccccccaattttttttaggggggggggcccccccccccgaaaagggcgccccaaaaaaaagaaaaaaaaaaatatcccccccggccaaaaaa

SEQ ID NO: 39226 - protein, 77 aa, Zea mays
  misc_feature: Ceres CLONE 1428987-F
MGKGSVGASWWAFLLLAGVLLVVAATAGAEDGVVERDRKEDLRWCKQACEWQYGKGHPRRKKGIGQNPVGPQAAPPI

SEQ ID NO: 39227 - DNA, 726 bp, Zea mays
  misc_feature: Ceres CLONE 1428991-F
  misc_feature: Encodes the peptide sequence at SEQ ID NO. 39228
  misc_feature (634)..(634): n is a, c, t, g, unknown, or other
tccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattgaggaaggacttgtaccattggagatgactcgtcatgtttcaatgatatcgatttccttgtcacctaangagcataacaagaattcacctgggtatcaagctcctctacattcggatcttaagccacaaagatatctgcaacctcagcaatatcaacagta

SEQ ID NO: 39228 - protein, 146 aa, Zea mays
  misc_feature: Ceres CLONE 1428991-F
  misc_feature (18)..(88): Pfam Name: Alba Pfam Description: Alba
  misc_feature: SWISSPROT Homolog: EC 3.1.26.5 Ribonuclease P
  misc_feature (116)..(116): Xaa is any aa, unknown, or other
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLVPLEMTRHVSMISISLSPXEHNKNSPGYQAPLHSDLKPQRYLQPQQYQQ

SEQ ID NO: 39229 - DNA, 707 bp, Zea mays
  misc_feature: Ceres CLONE 1428994-F
  misc_feature: Translation starting site: 221
  misc_feature: Pfam Name: Sod_Cu Pfam Description: Copper/zinc superoxide dismutase (SODC)
  misc_feature: SWISSPROT Homolog: EC 1.15.1.1 Superoxide dismutase
ccccgcggtggcggccgctctagaactagtggatcccccgggctgcaggaattcgcacgagaccattacctagaacatcctaatcgaaaaatcctcgcttcaggtctgcagcccccaactacccccagcctcggaaggaaccttccagaagcgcaagactctaaggccgtcaccttcccattcttcctcgccgcgggggtcgcctgagatcacataaacaatggtgaaggctgttgctgtgcttggtagcagtgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggtgtttattcttcttttactttggcttgcttatgtgatcagggtgtgtgctaagttaatattggccattgaactttctacttgttggtgaaatcaaggaccacactacaatcctgcgagcaaggagcatggggcaccagaagatgagaaccgccatgccggtgatcttggaaatgtgacagctggagcagatggtgttgctaatatcaatgtcactgacagccagatcccactgactgggccaaactcaatcattggcagagctgttgttgttcacgctgatcctgatgatcttggaaagggtgggcac

SEQ ID NO: 39230 - DNA, 733 bp, Zea mays
  misc_feature: Ceres CLONE 1428996-F
  misc_feature: Encodes the peptide sequence at SEQ ID NO. 39231
aaagctggagctccccgcggtggcggccgctctataactagtggatcccccgggctgcaggaattcgcacgagaccattacctagaacatcctaatcgaaaaagtggttgctgtgcaatcagctagtagctaggtagtcgaggttctccttgcctctccttggctccttccatcattccatcgtctttgctcgaggagtcgaggttcaggttccacggtgcggcgagagctagctcgcagccatggagagcaagagcccatggtcgctgcggctgctaatttgctgcgcggcaatggtggccatcgcgcttctcccccaacaaggaggccaggccgcttgtttcgtgccgacgccgggtccagctccggcaccgcccggctcctccgcgacgaacacgaacgcctcctccgctgctcctcggccagccaagcccagcgcattcccgcccccaatgtacggtggtgtcacccccggcaccggcagcctccagccccacggtccgtaccgtacgcgactttagctaaaagagagcagcacctctctgaagtctgaaccgcacggtcgtcgtcaattaataaaggtttcgctgtgctgcgtgtgcgtgtttgcaacagagtgcggcggccggtgcgcggagcggtgctcggcgacggcgtaccagaagccgtgcctcttcttctgccgcaagtgctgcgcggcgtgcctgtgcgtgccgccgggcacctacggcaa

SEQ ID NO: 39231 - protein, 92 aa, Zea mays; identical to SEQ ID NO: 38642
  misc_feature: Ceres CLONE 1428996-F

SEQ ID NO: 39232 - DNA, 728 bp, Zea mays
  misc_feature: Ceres CLONE 1428997-F
  misc_feature: Encodes the peptide sequence at SEQ ID NO. 39233
aagctggagctccccgcggtggcggccgctctttaactagtggatcccccgggctgcaggtattcgcacgagaccattacctagaacatcctaatcgaaaaagtggttgctgtgcaatcagctagtagctaggtagtccagggtctccgtgcctctcctggggtccttccatcattccagcgtctttgctcaaggagtcgaggttcaggttccacggtgccccgagagctagctcgcagccatggagagcagcagcccatgggcgctgcggctgctaatttgcggcgcggcaatggtgggcgtcgcgcttctcccccaacaaggaggccaggccgcttgtttcgtgccgacgccgggtccggctccggaggcgcccggctcctccgggacgaagacgaacggctcctccgctgctcctcgggcggccaaggccagcgcattcacgcccccaatgtacggtggtgtcacgcccgggagcggcagcctccctccccacgggccggagggggacgcgacttcagctaaaacagaggagtcacctcttgtgagagtctgaaccgcacggccgtcctgcgattgggtaagggctttcgctttgggtgcgaggggcggcgtcttgcgacagaagtgcgcgtgggccgtttgcgctgtatcgggtgcggcggccgaggggcgagacgagaaggggggggggcctcatgcgctcgcgacgcagaagggggcgaggg

SEQ ID NO: 39233 - protein, 104 aa, Zea mays
  misc_feature: Ceres CLONE 1428997-F
MESSSPWALRLLICGAAMVGVALLPQQGGQAACFVPTPGPAPEAPGSSGTKTNGSSAAPRAAKASAFTPPMYGGVTPGSGSLPPHGPEGDATSAKTEESPLVRV

SEQ ID NO: 39234 - DNA, 698 bp, Zea mays
  misc_feature: Ceres CLONE 1428999-F
  misc_feature: Encodes the peptide sequence at SEQ ID NO. 39235
acccgcggtggcggccgctctagaactcctggatcccccgggctgcaggaattcgcaccagaccattacctagaacatcctaatcgaaaaattttcatttccccacctctctaaaaccctcgctcttgcccgctgttttacacctaaaagaaaggtcctcgccgtcgagccgccggctcccatctcccgcgccgtcgccgacgaggacacaccagacgcctcgctgatggccttggctcgcctcggacggtctcttgccggccgcctccaccgttctatctaccgtccaccggcgcccacagactaccatgcctccgtttcccgacccttcgctccgacccacacaggcgtatgcgtacgaggttttgcaagcttgacgtacaatgccagcagcatgattgggcacaatctcgagggggcgtttgcagtccacattgtgaaggttctggatctcgtagtactatgaatcatgctagaccgatgtcaacagcaccagcatcaaaagtgcctgttgggaacccggaaagttggtctgaaggttccatgatgaatcccgggtttccaaattgagccgtacaagccccgggaacccattcccttttgggaaaaaagggtttcccctaaagggctggggaagggccaaggggggccctccttttttggaaaataaaaaacccaatttcttgtttttcgggtgt

SEQ ID NO: 39235 - protein, 79 aa, Zea mays
  misc_feature: Ceres CLONE 1428999-F
MALARLGRSLAGRLHRSIYRPPAPTDYHASVSRPFAPTHTGVCVRGFASLTYNASSMIGHNLEGAFAVHIVKVLDLVVL

SEQ ID NO: 39236 - DNA, 664 bp, Zea mays
  misc_feature: Ceres CLONE 1429001-F
  misc_feature: Encodes the peptide sequence at SEQ ID NO. 39237
  misc_feature (540)..(540): n is a, c, t, g, unknown, or other
  misc_feature (591)..(591): n is a, c, t, g, unknown, or other
gctctagaactagtggatcccccgggctgcaggaattcgcacgagaccattacctagaacatcctaatcgaaaactagcccccgaatcagatcccaccgcccgccggagcgcggaaccctgcccccggccgccatggacatgagcgatgcggagcggctgttcttcttcgagatggcctgcaacaactccgaggtcgcgtacgagcagaaccccaacgacgccgacaacttgacgcgatggggcggagcgctgctggagctatcgcagctgcgtaacggccccgacagcttcaagctcctccaagatgcggaagccaagctggaggaggcactgcaaattgatcccaacaagtctgatgcactctggtgcttgggaaatgctcagacttctcatggattcttcactccagacactgcaattgcaaatgagttctttgcgaaagcaactgaatgtttccagaaggctgctgatgtggaacctgcaaatgagctgtacaggaagtcattagacttgtcagcgaaggcacctgaactgcactncgagatccacaggcaaatggcttctcaagcggcaacccaagcatcctcagnctccaaatcaacgcaatcagggaagaaaaagagaaggcccccgacttctggtacgatgttggggaatggggga

SEQ ID NO: 39237 - protein, 177 aa, Zea mays
  misc_feature: Ceres CLONE 1429001-F
  misc_feature (6)..(170): Pfam Name: TOM20_plant Pfam Description: Plant specific mitochondrial import receptor subunit TOM20
  misc_feature (136)..(136): Xaa is any aa, unknown, or other
  misc_feature (153)..(153): Xaa is any aa, unknown, or other
MDMSDAERLFFFEMACNNSEVAYEQNPNDADNLTRWGGALLELSQLRNGPDSFKLLQDAEAKLEEALQIDPNKSDALWCLGNAQTSHGFFTPDTAIANEFFAKATECFQKAADVEPANELYRKSLDLSAKAPELHXEIHRQMASQAATQASSXSKSTQSGKKKRRPPTSGTMLGNGG

SEQ ID NO: 39238 - DNA, 742 bp, Zea mays
  misc_feature: Ceres CLONE 1429004-F
  misc_feature: Translation starting site: 504
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaaccatttcgaatcccaccgaattcactgcgattactctcacatctcctgctcgtctccccctaggggatcgtccgaccacgaatcccggagagggccatctcatccaagttaaggaagccatccagcacaccgatgctgggtgccttctccccgaaggacccatcctctgcatcaataactgtggcttcatcggcagccccgcgaccatgaactatgtgctcctagtgccaccccgacatgatcactaaccaggatcaggccaagatggctacctcctctatcgacggcatcgtgaacggcacccactccctcctggagcctcgctgttgctgagcaacaacacgaaagtagctgttgccccagttgagttgccaacaatgaacgtgcagcattccgatcatgttgccggacccagcaaggggagcggcggcaatctccaaagggatgaaggtagggccgaaccggtgcagcgcctgcacgaagatggttggacttacgggattccactgccggtgtgggaacttgtactgcgcactccaccgatgctccgattagtgcgactgctagttcgactacctgactgctgacttggacgccattagacaagttaatccgtgtgagcaggcagaccatctcca

SEQ ID NO: 39239 - DNA, 664 bp, Zea mays
  misc_feature: Ceres CLONE 1429005-F
  misc_feature: Encodes the peptide sequence at SEQ ID NO. 39240
  misc_feature (649)..(649): n is a, c, t, g, unknown, or other
ctggagctccccgcggtggcggccgctctagaactagtggatcccccgggctgcaggaattcgcacgagaccattacctagaacatcctaatcgaaaactttcctttccctacggcggcggcgctggagcagctaagcagcagcaagatgttcgacggcttcaatctccgcttccgccgccagagcgccacccttggctgcgccatgactttctccatctacctgcccccgtccccggtgtccaaccttcccgtgttgtactggctctcgggtctcacctgcaccgaggataatttcatcataaagtccggcgcccagcacgccgccgctgcccacggcatcgccctcgtggcacctgacacctccccacttatcttctgcatgatggattcatttgatggaactattttaggcctctgattgcggaatacagatcgatttgcttgtcacaaggataaagcagatccacgatgagtagaagcgtgggcatccaaatgaataaccaggggagagcagtctaaggcaaatttgctaggctggagcagtcacaagagctagggactacagtcataagtcctgctagcaggggtggagcaatcataagacctcctagcagtccaagcaaatttgctaggtgggatggaacttngtgccacactgcccc

SEQ ID NO: 39240 - protein, 90 aa, Zea mays; identical to SEQ ID NO: 18079
  misc_feature: Ceres CLONE 1429005-F
  misc_feature: SWISSPROT Homolog: EC 3.1.2.12 S-formylglutathione hydrolase

SEQ ID NO: 39241 - DNA, 690 bp, Zea mays
  misc_feature: Ceres CLONE 1429011-F
  misc_feature: Encodes the peptide sequence at SEQ ID NO. 39242
ggccgctctattctagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggagggcaagggggcgagagcgtgagtccaacgccggcgctcgggctgctctgcttccggaaggaagatgctgacgccctgctggagcaaatggatggcaatatgcgcgccggctctggtggcgttcctggcgcgctgaaaaaggttatccaaattgagtccggagggggtggcgttttaaattccctcgccgtaatcatct

SEQ ID NO: 39242 - protein, 170 aa, Zea mays
  misc_feature: Ceres CLONE 1429011-F
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGGESVSPTPALGLLCFRKEDADALLEQMDGNMRAGSGGVPGALKKVIQIESGGGGVLNSLAVII

SEQ ID NO: 39243 - DNA, 654 bp, Zea mays
  misc_feature: Ceres CLONE 1429012-F
  misc_feature: Encodes the peptide sequence at SEQ ID NO. 39244
  misc_feature (419)..(419): n is a, c, t, g, unknown, or other
  misc_feature (460)..(460): n is a, c, t, g, unknown, or other
  misc_feature (511)..(511): n is a, c, t, g, unknown, or other
  misc_feature (514)..(514): n is a, c, t, g, unknown, or other
  misc_feature (553)..(553): n is a, c, t, g, unknown, or other
  misc_feature (614)..(614): n is a, c, t, g, unknown, or other
  misc_feature (628)..(628): n is a, c, t, g, unknown, or other
  misc_feature (647)..(647): n is a, c, t, g, unknown, or other
aagctggagctccccgcggtggcggccgctctagaactagtggatcccccgggctgcaggaattcgcacgagaccattacctagaacatcctaatcgaaaaagtttgtttgcgcgaaaaaggataggaatcctcttgtgtcctggccgtcggccgtcgctgcgtcgttccagatttggggaaggaaatccggcaccgagattcgagtcgaaaaggacatcatttgctagatggcgcgtaccaagcagaccgctcgcaagtccactggaggaaatgctcctaggaagcaactcgctacaaaggcagcccggaagtctgcacccacaactggaggagtgaagaagcctcaccgttaccgcccagggactgttgctcttcgtaagatccgcaagtaccagaagagcactgagttgctgattnagaagctgccgttccagaggcttgtgagggagattgctcangatttcaagacggatctgcgcttccagagccatgccgtgcttgctctgcangangcagcagaagcctacctggttggtctcttcgagataccnatctgtgcgcgatccatgccaagcgcgtgaccatcatgcccaaggacattcagctggcaanaaggatccgtgccnagagggcttgagtctgtcnacgggag

SEQ ID NO: 39244 - protein, 117 aa, Zea mays
  misc_feature: Ceres CLONE 1429012-F
  misc_feature (58)..(114): Pfam Name: Histone Pfam Description: Core histone H2A/H2B/H3/H4
  misc_feature (64)..(64): Xaa is any aa, unknown, or other
  misc_feature (77)..(77): Xaa is any aa, unknown, or other
  misc_feature (94)..(94): Xaa is any aa, unknown, or other
  misc_feature (95)..(95): Xaa is any aa, unknown, or other
MARTKQTARKSTGGNAPRKQLATKAARKSAPTTGGVKKPHRYRPGTVALRKIRKYQKSTELLIXKLPFQRLVREIAXDFKTDLRFQSHAVLALXXAAEAYLVGLFEIPICARSMPSA

SEQ ID NO: 39245 - DNA, 711 bp, Zea mays
  misc_feature: Ceres CLONE 1429013-F
  misc_feature: Encodes the peptide sequence at SEQ ID NO. 39246
  misc_feature (554)..(554): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaaaagttgtatgttgtagacgggcgagtgcgacgagcggagaacgtaatgccagcgctacaccgctgacgtgtccgccccggctccgggtgaaggtcaaaaggggcaaagggcggggggaaaccgtgggccctatatagcgggccttctcgctggagctaggagaaatcgccaagccaagccaagccagaagcggcagcctcgcgcagcggtctggtctctctggtgggtgcccctcttcgccggtggccggaaagggtagtggagtgggaccgctcaaggagaggacggcgtccccaagtctcacttccgccgtccgcttcccccctgggatctagggaggaatgaaaggaggtgcttcacaatgaaggccctcattcttgtcgggggtttcggaacccgccttcggcctttgactctgagcttcccgaaacccctcgtggattttgcaaacnagcccatgattctgcgccagatcgaagctttgtacgaagttgggatcacagaggtggtgttggctatcaactaccgcccagaggtaatgattaatttccttgaggactttgaggatnagcttggcatcacaattacatgctcccaaggagatgaagc

SEQ ID NO: 39246 - protein, 82 aa, Zea mays
  misc_feature: Ceres CLONE 1429013-F
  misc_feature: SWISSPROT Homolog: EC 2.7.7.13 Mannose-1-phosphate guanylyltransferase
  misc_feature (31)..(31): Xaa is any aa, unknown, or other
  misc_feature (70)..(70): Xaa is any aa, unknown, or other
MKALILVGGFGTRLRPLTLSFPKPLVDFANXPMILRQIEALYEVGITEVVLAINYRPEVMINFLEDFEDXLGITITCSQGDE

SEQ ID NO: 39247 - DNA, 649 bp, Zea mays
  misc_feature: Ceres CLONE 1429016-F
  misc_feature (216)..(216): n is a, c, t, g, unknown, or other
gctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcancgcggcggaaccgaaatggttgcccgtgcggtggaatggctgatccgcggtggcgaccccgtgcggcgccgaaaaagaaaccggttagggccgcacctccgaaggcgcccccaaggccgtaaggggaaacccggaaaggggggggtgagggatttttaaaccccctttggaaaccctgggaatcttttttttaaatgaaaccccccgggaaagaatttttgtgccaaaccccccccccgggggagaggggggccccccccctcttttcccaaaacccccttttttttttttccccagaaaataaattaaaggggggccccaacaattcccgcccgcgtttttttttttaaaaaaaaacaaaaaaaaaatttttttttttttggggccccccccccttttttattgtgggcggggggaataaaacccccccccc

SEQ ID NO: 39248 - DNA, 662 bp, Zea mays
  misc_feature: Ceres CLONE 1429019-F
  misc_feature: Encodes the peptide sequence at SEQ ID NO. 39249
tccccgcggtggcggccgctctagaactagtggatcccccgggctgcaggaattcgcacgagaccattacctagaacatcctaatcgaaaaatcgattcattgccacaaggcagctgattgctcacagcgttggatgtgagaattggattcggacccaccgatcgatatgccgttcggccacacgcggctcgatgtccggcgtccgccgcagtcgtcctacctctgctgctccacaaccaccgtcgccgtattcgtcgcgctctgcctggtggctgtgtggatggcgtcgtccatgctcgtcacccctgccgagttccctccatttcagtccaaagtgcgtccactgaggcctcatgactctcctcctgccaccggaagcttaaccagtgctgatcagggcgatggcatcaccacccatgatgatccaccacctgctacacaacaattgcctcctgtaacagacagcatggatggtgaaaatcagcaacaagaaacttttcactacagaagcgcggaccatggtccaaccaaggctgaaacaatctaaacaagggacgcttaaagagcaaacccttgaccgtcaagtaagccccactgagctttccgttgggggcgttattgcaaaccgtccaagcctggaaacataatttattatccccct

SEQ ID NO: 39249 - protein, 126 aa, Zea mays
  misc_feature: Ceres CLONE 1429019-F
MPFGHTRLDVRRPPQSSYLCCSTTTVAVFVALCLVAVWMASSMLVTPAEFPPFQSKVRPLRPHDSPPATGSLTSADQGDGITTHDDPPPATQQLPPVTDSMDGENQQQETFHYRSADHGPTKAETI

SEQ ID NO: 39250 - DNA, 772 bp, Zea mays
  misc_feature: Ceres CLONE 1429021-F
  misc_feature: Encodes the peptide sequence at SEQ ID NO. 39251
  misc_feature (17)..(17): n is a, c, t, g, unknown, or other
  misc_feature (51)..(51): n is a, c, t, g, unknown, or other
  misc_feature (631)..(631): n is a, c, t, g, unknown, or other
tttgggggaggaccccncccaacgactggagaaaggcctaataatttgttntcttaaaactgggactccccgcggtggcggccgctctagaactagtggatcccccgggctgcaggaattcgcacgagaccattacctagaacgtcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccactgggcgggctgctgctggtgctgtcggggctggcgctgacaccctccgtggtggggctggccgtggccacgccggtgttcctgatcttcagcccccagctggtccccgccgcgctgctcatcgggggacggccgtcatgggggttcctcaacgtcgggcgcgctgggggcccggggggcctgtccctccgcccacggggccntgggccaaaaacgcggggcggcagggggtttcccgacccacaccgccgggacttacgttgggaagggagggcccgcacccggcaatggatggggctgggaacggtccggccgggctccctaccgcgcggggacgccaaaag

SEQ ID NO: 39251 - protein, 170 aa, Zea mays
  misc_feature: Ceres CLONE 1429021-F
  misc_feature (44)..(140): Pfam Name: Oleosin Pfam Description: Oleosin
  misc_feature (124)..(124): Xaa is any aa, unknown, or other
MADRDRSGIYGGAHATYGQQQQQGGGGRPMGEQVKGMLHDKGPTASQALTVATLFPLGGLLLVLSGLALTPSVVGLAVATPVFLIFSPQLVPAALLIGGRPSWGFLNVGRAGGPGGLSLRPRGXGPKTRGGRGFPDPHRRDLRWEGRARTRQWMGLGTVRPGSLPRGDAK

SEQ ID NO: 39252 - DNA, 706 bp, Zea mays
  misc_feature: Ceres CLONE 1429022-F
  misc_feature: Encodes the peptide sequence at SEQ ID NO. 39253
  misc_feature (1)..(1): n is a, c, t, g, unknown, or other
  misc_feature (374)..(374): n is a, c, t, g, unknown, or other
  misc_feature (375)..(375): n is a, c, t, g, unknown, or other
  misc_feature (433)..(433): n is a, c, t, g, unknown, or other
  misc_feature (476)..(476): n is a, c, t, g, unknown, or other
nagagctggagctccccgcggtggcggccgctctagaactagtggatcccccgggctgcaggaattcgcacgagaccattacctagaacattctaatcgaaaaacaccgcaggacaggagaagcttgggtctcctatcctccccacccctctctcggtctcttccccaccgcgtcttcgtcgtctcgtcttcctgcctccttcgcccgagaaaggagagaatggggagcagcgagaagaccgttaccgcttacggcgagtacacctacgctgagctggagagggagccctactggccgagtgagaagctgaggatttcgattactggggctggtggtttcattggatcccacattgctcgccgtctgaagaacnngaggcattacatcattgcctctgactggaagaagaacgagcacatgaccgaagacatngtctgccatgagttccaccctcgtgatctcagggtcatggacnactgtctcaaggtcacccaggtgtcgaccatgtcttcaatctccctgctgatatgggtggcatgggggttcatccagtcaaatccctctggggatcttgtacaacaaccccctggaccgttttaacatgctggaggctgcacgtttcaaggggtggaaagggttcttctatgcccccaggggatggcttttccccggggttcagcggctcccaccaaatgtgagcttgta

SEQ ID NO: 39253 - protein, 126 aa, Zea mays
  misc_feature: Ceres CLONE 1429022-F
  misc_feature: SWISSPROT Homolog: EC 5.1.3.18 GDP-mannose 3,5-epimerase
  misc_feature (52)..(52): Xaa is any aa, unknown, or other
  misc_feature (71)..(71): Xaa is any aa, unknown, or other
  misc_feature (86)..(86): Xaa is any aa, unknown, or other
MGSSEKTVTAYGEYTYAELEREPYWPSEKLRISITGAGGFIGSHIARRLKNXRHYIIASDWKKNEHMTEDXVCHEFHPRDLRVMDXCLKVTQVSTMSSISLLIWVAWGFIQSNPSGDLVQQPPGPF

SEQ ID NO: 39254 - DNA, 733 bp, Zea mays
  misc_feature: Ceres CLONE 1429024-F
  misc_feature: Encodes the peptide sequence at SEQ ID NO. 39255
agagctggagctccccgcggtggcggccgctctagaactagtggatcccccgggctgcaggaattcgcacgagaccattacctagaacatcctaatcgaaaaacattcctaaagtttgtgtccgcaatgatccaaagtccaccaaaccgagatcatgtggaggatcatcaatcatttgatctggaagattggcttccaataacagcatcaagaaatgcaaattggtactattcagctttccacaacgtaactgcaatggttggtgctggagttcttggccttccctacgccatgtcagagcttggatggggacctggggttgcggtgctgatcctgtcatgggtgatcacgttgtacaccctctggcaaatgattgagatgcacgagatgtttgaagggcaacggtttgataggtaccacgagctgggtcaggcagcctttggaaggaagcttggtttgtatatcatcgtgccgctacagcttcttgttgaaaccagtgcgtgcattatctatatggtgaccggaggtgaatcgttgaaaaaggttcatcaactttctgtgggagatgacaagtgcacaaagctgagaatcgaatacttcattttgatatttgcctcttcacagtttgtgctctcccttctaaagactttcactccatttccggtgtctctttggtggctgccgtcatgtctgtaagctactccacgatagcttgggtagcctcactggcaag

SEQ ID NO: 39255 - protein, 189 aa, Zea mays
  misc_feature: Ceres CLONE 1429024-F
MIQSPPNRDHVEDHQSFDLEDWLPITASRNANWYYSAFHNVTAMVGAGVLGLPYAMSELGWGPGVAVLILSWVITLYTLWQMIEMHEMFEGQRFDRYHELGQAAFGRKLGLYIIVPLQLLVETSACIIYMVTGGESLKKVHQLSVGDDKCTKLRIEYFILIFASSQFVLSLLKTFTPFPVSLWWLPSCL

SEQ ID NO: 39256 - DNA, 668 bp, Zea mays
  misc_feature: Ceres CLONE 1429026-F
  misc_feature: Encodes the peptide sequence at SEQ ID NO. 39257
  misc_feature (486)..(486): n is a, c, t, g, unknown, or other
aaagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctctacctctgccctcctcgctgcgccgtgccccccgcgcgcggggcggcgccggttcccgttggaaacgccccggggcccccgaaggggtnccccggggaaggggcttgtttctaagggcccccaaagggggggccccccccccctggggcccgggggggccttttttaattccctccccccggggggtgtggggggccaaagggctccccttttcacaccccccaagggcccccccccccggccttgggggggccccccccccctctttttt

SEQ ID NO: 39257 - protein, 51 aa, Zea mays
  misc_feature: Ceres CLONE 1429026-F
  misc_feature (44)..(44): Xaa is any aa, unknown, or other
MAPLPASLTPCLWLYLCPPRCAVPPARGAAPVPVGNAPGPPKGXPGEGACF

SEQ ID NO: 39258 - DNA, 732 bp, Zea mays
  misc_feature: Ceres CLONE 1429028-F
  misc_feature: Encodes the peptide sequence at SEQ ID NO. 39259
  misc_feature (647)..(647): n is a, c, t, g, unknown, or other
aaaagctggagctccccgcggtggcggccgctctagaactagtggatcccccgggctgcaggaattcgcacgagaccattacctagaacatcctaatcgaaaaatcccttatcctgactctggcgctgccgctgccgccgcccatgtccgccgccccgccccgccgcgtggtcatctgcagcggcggcgtggtgggcgcgtgcacagactacttcctcgccaccaacgcctcgtcccccaccgtcccgacgctcgtcaagaggtgcgccccggcgtgcgccgcctcagggaaagccagcggcttcctggcgctggactggtgcgactccaccccggcgctgtccaggctcgcgcgggcctccttcgcgctccaccgccgcctggccgacgccctctgaggcgccgacgcctacggtttccgccccgtccacaccctctccatcctgctccccccgcacccctacgcctcctcctcctcgacgcagcacccgctgctcccgccctgggtcgactcctccgcgtccgccgcaccgccgagagagctcgggacccccgacaccacatggcaggtccacccgggcctcttcactaaagccgtcctcgccgcgtctggagccgaggtcgtcattgccgagatgcagcgcgtnctcttggcacgggacggccgcttcgccggcatcgtggtcaaggggcgctacggcttgatggacaccgaccccgtcgtgctcgcgc

SEQ ID NO: 39259 - protein, 84 aa, Zea mays
  misc_feature: Ceres CLONE 1429028-F
MSAAPPRRVVICSGGVVGACTDYFLATNASSPTVPTLVKRCAPACAASGKASGFLALDWCDSTPALSRLARASFALHRRLADAL

SEQ ID NO: 39260 - DNA, 713 bp, Zea mays
  misc_feature: Ceres CLONE 1429039-F
  misc_feature: Translation starting site: 511
tccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaaggctgaggacgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaaga

SEQ ID NO: 39261 - DNA, 719 bp, Zea mays
  misc_feature: Ceres CLONE 1429040-F
  misc_feature: Encodes the peptide sequence at SEQ ID NO. 39262
  misc_feature (703)..(703): n is a, c, t, g, unknown, or other
tccccgcggtggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtggcagctggtgctaatccctgtcagattactcgtggtattgagaaaacagcntaagcactagttgaag

SEQ ID NO: 39262 - protein, 158 aa, Zea mays
  misc_feature: Ceres CLONE 1429040-F
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPCQITRGIEKTA

SEQ ID NO: 39263 - DNA, 678 bp, Zea mays
  misc_feature: Ceres CLONE 1429041-F
  misc_feature: Translation starting site: 190
  misc_feature (261)..(261): n is a, c, t, g, unknown, or other
  misc_feature (262)..(262): n is a, c, t, g, unknown, or other
  misc_feature (477)..(477): n is a, c, t, g, unknown, or other
aaagctggagctccccgcggtggcggccgctctagaactagtggatcccccgggctgcaggaattcgcacgagaccattacctagaacatcctaatcgaaaacccaacctcatcttctctccctttgctcggaacgcacacaccgcccggtctccgatctccgatccccgatcccctcgtcgatccaagatgcagatcttcgtcaagactctcactgggaagactatcaccctcgaggtggagtcctctgacaccattganncacgtcaggccaagatccaggacaaggaaggcattccccccgacagcagcggctcatcttcgctggcaagcagctcggagacgggcgcacacttgccgactacaacatccagaaggagagcaccctccacctttgttctcggctcaggggaggcatgcaaatctttcgtcaagaccctcactgggaagactatcaccctcggaggtggagtcttnctgacaccatccaacacgtcaaggccaagatcaaggacagggaggccatccctccgggaccagcaagcggctcatttttttctggaaaacaacttgaagacgggcccacccctggcccaattacaacattcaaaaaggagaccccccctcccccttggtgtttccgctcccagggggcagcaatccaaaatcttccgtgaa

SEQ ID NO: 39264 - DNA, 657 bp, Zea mays
  misc_feature: Ceres CLONE 1429044-F
  misc_feature: Encodes the peptide sequence at SEQ ID NO. 39265
  misc_feature (403)..(403): n is a, c, t, g, unknown, or other
  misc_feature (657)..(657): n is a, c, t, g, unknown, or other
ctggaactagtggatcccccgggctgcaggaattcgcacgagaccattacctagaacatcctaatcgaaaactagctcgtgcatgccgccctgagcgccactgcacagacgcgcagagacagacattgcgactttgcgagagacaaaacctcccagataacgcccgcgcgctccccgatggcgtcgtcgtgccagaacgtggagattcccggcaagccgacggagacggggacggcgctgctggagacggcgacgggcaccatccaggggttcgcgccgctgagccagatccaccagcacctgtgcgcgttccacttctacgcggacgacatggggcggcaggtggaggcgcaccacttctgcgcgcacctgaacgaggacgtgcggcagtgcctcatcttcnacgggcccggcgccggcgcgcgcctcatcggcgtggagtacatcgtctccgagacggtgttcctgacgctgcccgacgccgagaagccgctgtggcacacgcacgagttcgaggtgaaaggggggggtgctgttccttgccggggggtgcccggcggtgggggaaccgccgggaacctgggagaagggggtggcatgaacctacgggcaagacccatccccctttctggggaaggggggaaccgccggccaacn

SEQ ID NO: 39265 - protein, 160 aa, Zea mays
  misc_feature: Ceres CLONE 1429044-F
  misc_feature (11)..(159): Pfam Name: DUF1264 Pfam Description: Protein of unknown function (DUF1264)
  misc_feature (76)..(76): Xaa is any aa, unknown, or other
MASSCQNVEIPGKPTETGTALLETATGTIQGFAPLSQIHQHLCAFHFYADDMGRQVEAHHFCAHLNEDVRQCLIFXGPGAGARLIGVEYIVSETVFLTLPDAEKPLWHTHEFEVKGGGAVPCRGVPGGGGTAGNLGEGGGMNLRARPIPLSGEGGNRRPT

SEQ ID NO: 39266 - DNA, 603 bp, Zea mays
  misc_feature: Ceres CLONE 1429045-F
  misc_feature (159)..(159): n is a, c, t, g, unknown, or other
  misc_feature (166)..(166): n is a, c, t, g, unknown, or other
  misc_feature (197)..(197): n is a, c, t, g, unknown, or other
acaaagctggagctccccgcggtggcggccgctctagaactagtggatcccccgggctgcaggaattcgcacgagaccattacctagaacatcctaatcgaaaactggtcctccattcaagctccactactccacacctagacttcccaatccctcatngggcaanctgtcacacagtaacgcgtcgcctgtggttnggtttgtggagtgggggagaagagggggagggacttgcctccgactccgaaagaaagaaagatgtccaaggaacgcagaaggcggctgctctcaagaaaaactaaaatcctccgctcataattaatcccagggtttaaaaaacgtcaaaaaattggaaccgtcggcgtaaataagaacttaaccaaaaggggtaaacctaaaccgaaaattgggggcgcccaaaacccttaaaaaaaaggtctttcctttccccggggacccggaaaccctagaggggcggggggtcccttccttggggaaaatttttcccaaaaaaaatcccggggggggccccccccccgggggaaagccttccaaaaaaggggggggaaaaggggttcaaaaaacccggttttgggggaaaaa

SEQ ID NO: 39267 - DNA, 816 bp, Zea mays
  misc_feature: Ceres CLONE 1429048-F
  misc_feature (7)..(7): n is a, c, t, g, unknown, or other
  misc_feature (14)..(14): n is a, c, t, g, unknown, or other
  misc_feature (20)..(20): n is a, c, t, g, unknown, or other
  misc_feature (21)..(21): n is a, c, t, g, unknown, or other
  misc_feature (816)..(816): n is a, c, t, g, unknown, or other
ggggggnggggggngggggnnttttgttttgttttttttttttgggccccacaacaaaactggaactccccgcggtggcggccgctctagaactagtggatcccccgggctgcaggaattcgcacgagaccattacctagaacatcctaatcgaaaagaaagtttcgaacaaaagtccacaaatcgccttcgccgtctccggagagccccgcccctcatcgccgccgcgccagagagactgtgagtacgggggatggaacaggccatctgaatggggtgcgatgccctcccgccagtgccaagcccgattgagtccgacgagaagggagtttcccgacgccgtatcccagcgccccgagccgggcgagacggagagcaccccctgcctgccggaagctgggacccaccgtcgggaggcatcgggtgcacgacttgcgggggggggtgggaaaggcctcgggcgtactacaacctttctccgtgggaggaacccttccccgggccacacagtcccccgagggggggcgtcaaaggtcatcgactggccccgactggggtgtgggcccagggcccctacaaaaacctctgctttgttctttgtgggtaccgaggcccccccggcgtggccacccaagcaccttccaataacccccagggcgccataaaacacacacaatgccgagaatgccccgggtaacgccgcggggcacaccctgggggggcgggacccctcccccccccgttcgccccccggggcccgcgcgcgcctacacacccttacacgcgaaggagcaaatgccggcgccgcctctttcn

SEQ ID NO: 39268 - DNA, 636 bp, Zea mays
  misc_feature: Ceres CLONE 1429052-F
  misc_feature: Encodes the peptide sequence at SEQ ID NO. 39269
  misc_feature (304)..(304): n is a, c, t, g, unknown, or other
  misc_feature (337)..(337): n is a, c, t, g, unknown, or other
  misc_feature (346)..(346): n is a, c, t, g, unknown, or other
  misc_feature (415)..(415): n is a, c, t, g, unknown, or other
  misc_feature (460)..(460): n is a, c, t, g, unknown, or other
aagctggagctccccgcggtggcggccgctctagaactagtggatcccccgggctgcaggaattcgcacgagaccattacctagaacatcctaatcgaaaataactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaagaggcgcgcgcccgatgggtgagcangtgaagggcatgctccacgaacaggggccgacngcgtcgcangcgctgacagtggtgacgctgttcccgctgggcggactgctgctggtgctgtcggggctggcgctgacngcctccgtggtggggctaacagtggcaacgccggtgttcatgatnctcagcaccgtgctcgtccccgccgcgctgctcatcgggacggccgtcatgagatacctccacgtcgggcgcgctgggggctcgggggctgtcctcgctcaggtgcctcggcaacacggggccggagggcgtccagcggcaccccggactaaactggaggaagcccaccgcaggag

SEQ ID NO: 39269 - protein, 143 aa, Zea mays
  misc_feature: Ceres CLONE 1429052-F
  misc_feature (44)..(143): Pfam Name: Oleosin Pfam Description: Oleosin
  misc_feature (33)..(33): Xaa is any aa, unknown, or other
  misc_feature (47)..(47): Xaa is any aa, unknown, or other
  misc_feature (85)..(85): Xaa is any aa, unknown, or other
MADRDRSGIYGGAHATYGQQQQQGRGARPMGEXVKGMLHEQGPTASXALTVVTLFPLGGLLLVLSGLALTASVVGLTVATPVFMXLSTVLVPAALLIGTAVMRYLHVGRAGGSGAVLAQVPRQHGAGGRPAAPRTKLEEAHRR

SEQ ID NO: 39270 - DNA, 659 bp, Zea mays
  misc_feature: Ceres CLONE 1429063-F
  misc_feature: Encodes the peptide sequence at SEQ ID NO. 39271
  misc_feature (503)..(503): n is a, c, t, g, unknown, or other
ccgcggtggcggccgctctagatctcgtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaagcgtcagggatctcgtcgncagcgcccgcgccgtcggcatcctcagctcgtcggcctcaccaacagccgcgacagcccggccttgtaactgttcagggccccgtccaccctcggggtccgggttcctaaccgggcccccttgaaccgccgccccgcccgggcctttaaaattacg

SEQ ID NO: 39271 - protein, 94 aa, Zea mays
  misc_feature: Ceres CLONE 1429063-F
MLLTSCRQGRGMASLSCARADGVVRSGALPAKLLLCASCCFPTAAPVADGEVQVLACRQHLHRLPKRQGSRRQRPRRRHPQLVGLTNSRDSPAL

SEQ ID NO: 39272 - DNA, 666 bp, Zea mays
  misc_feature: Ceres CLONE 1429064-F
  misc_feature: Translation starting site: 234
  misc_feature: SWISSPROT Homolog: EC 5.3.99.6 Allene-oxide cyclase
tccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgatcttgtccccttcaccacaaggtgtacaacggcagcctggacaagcggctgggcgtcaccgcgggcatctgcgtgctcatccagcacgtccccgaccgcaacggcgaccgctacgagggcatctacagcttctacttcaa

SEQ ID NO: 39273 - DNA, 668 bp, Zea mays
  misc_feature: Ceres CLONE 1429065-F
  misc_feature: Encodes the peptide sequence at SEQ ID NO. 39274
tccccgcggtggcggccgctctagaactagtggatcccccgggctgcaggaattcgcacgagaccattacctagaacatcctaatcgaaaaagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagcaaggaagtccaactatactgatatggttaataaatactatgatcttgccactagcttctatgagtatgggtgggggtgaatcccttccaacttgctcacagatgggaattggagaaatcccttccctggaaaggcttccaagcgacatggggctttttctttgcccggacccttggtttaaaccccgaaaaaaaaggttttaaaagggggctggggaaaaggggggcccccttgagaaaatttccgaatttttctctcccc

SEQ ID NO: 39274 - protein, 67 aa, Zea mays
  misc_feature: Ceres CLONE 1429065-F
  misc_feature: SWISSPROT Homolog: EC 2.1.1.41 Sterol 24-C-methyltransferase
MSKSGALDLASGLGGKINKVEVKSAVDEYEKYHGYYGGKEEARKSNYTDMVNKYYDLATSFYEYGWG

SEQ ID NO: 39275 - DNA, 711 bp, Zea mays
  misc_feature: Ceres CLONE 1429072-F
  misc_feature: Encodes the peptide sequence at SEQ ID NO. 39276
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (39)..(39): n is a, c, t, g, unknown, or other
  misc_feature (387)..(387): n is a, c, t, g, unknown, or other
  misc_feature (493)..(493): n is a, c, t, g, unknown, or other
  misc_feature (495)..(495): n is a, c, t, g, unknown, or other
gtttgtccccaaannntnnnntttaaaaacgcacacccnttcgtaagggagaaagctggagctccccgcggtggcggccgctctagattcctggatcccccgggctgcaggaattcttaccagaccattacctagaacatcctaatcgaaaaacactgccttctctctctgactctgtgtccgtctctaaactctagtctgtgcgaatctgctgccagcagcgaggaacagaacagtagccaatttgccatctcacagttgcgttcctccgattccccgtcccccgatggacctgtctcccagctcgtcggcgccatccgcgccgccggtgccgtgcgagtggtccggcgccgggctcggctccgcggcgtgcggcctcgcctgcanggtgctctgcgccgtcgccacctgcgtcttcgcggccgtgggtcgctggccggggcggtgacggggtttccattttgccggggggcctttgggggttttaaaaatntnaaaaagcgggaatggttggccgggcccccggatttgggggccattttccggggcccgttcttttcccattcaagggtcgccaaaagttttccccccgaaaacctttggggaattcggggggaaaaccccccggggtttctggaaccccccccccccataacaggggggggaaaaaatattttccccccagtttcttctttgagaggggggaggggg

SEQ ID NO: 39276 - protein, 53 aa, Zea mays
  misc_feature: Ceres CLONE 1429072-F
  misc_feature (34)..(34): Xaa is any aa, unknown, or other
MDLSPSSSAPSAPPVPCEWSGAGLGSAACGLACXVLCAVATCVFAAVGRWPGR

SEQ ID NO: 39277 - DNA, 690 bp, Zea mays
  misc_feature: Ceres CLONE 1429073-F
  misc_feature: Pfam Name: DUF938 Pfam Description: Protein of unknown function (DUF938)
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (341)..(341): n is a, c, t, g, unknown, or other
  misc_feature (369)..(369): n is a, c, t, g, unknown, or other
  misc_feature (371)..(371): n is a, c, t, g, unknown, or other
  misc_feature (392)..(392): n is a, c, t, g, unknown, or other
  misc_feature (398)..(398): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaannnnnnccaaactggggctccccgcggtggcggccgctctagaactagtggatcccccgggctgcaggaattcgcacgagaccattacctagaacatcctaagaaaatcgcactcgtagtcgtagctcaagcatcagcggcaggagctctgggcagcgtgcgcacgtggggtacctagctcgctctgctagcctaccatggctgatcaccacgggggtgcgaacggaagtggcnggggctacggcgaccctcagcgcggggncngcatgcacggccaaagcgcancaccancaaaagcagggccccatgatgacgggcctctaagccccccaacggccgcaactttcgggggggtcaatgctggggcccttccgggctgatatctggccgggaacccggatccggcctcacggggggccaccccccgggctggtgatcttcagcccggcttgtttggggcccccccccccacctcggcgtgggggccttggggggggcgcgggttttttcccctcccggggggcccccgggggccccccgcccgtttccgtgtgttccccccgggagaaaaaaaaaaccctag

SEQ ID NO: 39278 - DNA, 642 bp, Zea mays
  misc_feature: Ceres CLONE 1429075-F
  misc_feature (36)..(36): n is a, c, t, g, unknown, or other
  misc_feature (38)..(38): n is a, c, t, g, unknown, or other
  misc_feature (40)..(40): n is a, c, t, g, unknown, or other
  misc_feature (57)..(57): n is a, c, t, g, unknown, or other
gtggtgggtggggggtgtggggttggctcgcgggcncngntgttttttgcggtctcnccgtgctctggtgtcgtttttttcatagctggactcacccggtggcggccgctctagaactagtggatcccccgggctgcaggaattcgcacgagaccattacctagaacatcctaatcgaaaaaaccaccaccgctctgcctcgcctcgcctcgcgtcgtctcacctcactcacctcgccgactagggtttgtacggccgtggatctcgccgtccccgccagggacgtctcgcacgcggggatcctccgttcggccggggaaggctcccacccaccggggagccaccggagggggacctccctccgccggggtctgcctccaaagggggggttcttccctgggggcccatttttccggagacaccccccggggaaaggttttgtgaccacccccggggtttttaaaaaaaattatccccaactggaaaacaaaaagggggaagttgcctggcgcccccgggaacccccccccgcagataaaaacaaaagttttttgtcgagatatggacacccctttttttcctccccccaacaaaaaaaaaaacatgtggtgtgaaaaacccccccccctcccctttaaattg

SEQ ID NO: 39279 - DNA, 687 bp, Zea mays
  misc_feature: Ceres CLONE 1429087-F
  misc_feature: Encodes the peptide sequence at SEQ ID NO. 39280
  misc_feature (687)..(687): n is a, c, t, g, unknown, or other
tcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaaccccgcgcggccaaggacgcgcggccgaacaaggtgcaggagctgtacgtgtacaagatcaacgagcggggaccgcgagagcccccgctacctgcgcctcaacgccaagcaaacggagaacgccctggggcgaccttggcccctttccacaaacaagggggaacaaaggccaccctgggacaaaccgggttgggcggtcacccgcggggaattcggcgggggttattccaaacacgttcccccgaacccgaaaaggggggaaccccctaacggaggccctattttaccaggtttttatactttaaaagaaactacccgccccacacn

SEQ ID NO: 39280 - protein, 162 aa, Zea mays
  misc_feature: Ceres CLONE 1429087-F
MAAALRCPASVRVSGPAAAGLAKVRQASRVVAVSGARQSRSGGVAVRASLFSPNPARPRTRGRTRCRSCTCTRSTSGDRESPRYLRLNAKQTENALGRPWPLSTNKGEQRPPWDKPGWAVTRGEFGGGYSKHVPPNPKRGEPPNGGPILPGFYTLKETTRPT

SEQ ID NO: 39281 - DNA, 722 bp, Zea mays
  misc_feature: Ceres CLONE 1429088-F
  misc_feature (722)..(722): n is a, c, t, g, unknown, or other
ctcgtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtccatctttgctgccttggcgagcttcagcccaatcaagggcgagcatggcggctggcccgttaatagagcaacacaaaacccttcaaattaatggggacatctgcaggaacagcgacccggcctgaacaccagggggggcacttcccccatcgccatcgcccctcgttgtccccttaacgctgtgggagggccatcgggcccacctccaacaatgcgggaatccgtagggccccatctagaggcgaccccccaaggaaacaataggtctggggccgcacgtttgctttaaagggaagatgttcctacgacactccaggggtttcgtacaaaggcggcccaccctcccn

SEQ ID NO: 39282 - DNA, 737 bp, Zea mays
  misc_feature: Ceres CLONE 1429095-F
  misc_feature: Encodes the peptide sequence at SEQ ID NO. 39283
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (32)..(32): n is a, c, t, g, unknown, or other
  misc_feature (39)..(39): n is a, c, t, g, unknown, or other
  misc_feature (51)..(51): n is a, c, t, g, unknown, or other
  misc_feature (52)..(52): n is a, c, t, g, unknown, or other
agtgtggggcgnagggnnggggggtgcttaancgcaccncaccggcacganntaaaagctcggactcaccgcggtggcggccgctctagaactagtggatcccccgggctgcaggaattcgcacgagaccattacctagaacatcctaatcgaaaactccactcctcctcctctctctctccacatttcctctcccgataagagtgaggcctcggctaagcttgagcttcccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaagaggagcccgtatccctccaccccgctgcccgccggaccgatggactccgaccacccccatctcgcgcctggccgccgcgaagcgcttctacgcggcgcagctcggccacagcgatcgggccgggatggacgagctggagagggacgacgaggtcagggcccgagttccccctgcccctactggctacgaggaccacgaacgtcgggatccctcctgcgcgcaccctggaaggatgagcacccacgtttcgaaatccccaaagccgccggggctgaccctgtgtctggctcagaagaatgggacaacgaaaaggcatactcg

SEQ ID NO: 39283 - protein, 65 aa, Zea mays
  misc_feature: Ceres CLONE 1429095-F
MDELERDDEVRARVPPAPTGYEDHERRDPSCAHPGRMSTHVSKSPKPPGLTLCLAQKNGTTKRHT

SEQ ID NO: 39284 - DNA, 651 bp, Zea mays
  misc_feature: Ceres CLONE 1429099-F
  misc_feature: Translation starting site: 172
  misc_feature (651)..(651): n is a, c, t, g, unknown, or other
gccggaattcgctcgagaccattacctagaacatcctaatccaaaacttcccttccccattattcccaggattccccttgcgactgcaccacgccccacccaaacccacctaccgcctccgctcccctctccagcgagtcgggggcacggacgggaccagacgaccaggccatggggaagtacatgcgcaagggcaaggtgtccggggaggtcgccgtcatggaggtacccggcggcgcgctgctcggcgtccgcacccgctcccgcacgctcgcgctgcagcgcgcgcagaggccgctcgacaaggggcgacgcggaggacgccgccgcggagtaccctcgagctcaggagccggaggctcgagaacccccacaggagcattcgtccccgcccgcgaacgccaccaagagggcccccgggaaggaaagccccccgcccccccccgcggggcaaccacgttcctaatgcaagaaccaaggtccaagggccaagggcccccctttcggggaaaaaacgtggtttggaacttggacacccctggggaaagggagtttccccaaaagaaccacccccccggggaaaacctctttttttttggaaccccccccaaaattatataaaagccccccccccgggtgttcccccccaan

SEQ ID NO: 39285 - DNA, 861 bp, Zea mays
  misc_feature: Ceres CLONE 1429100-F
  misc_feature (23)..(23): n is a, c, t, g, unknown, or other
  misc_feature (24)..(24): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (49)..(49): n is a, c, t, g, unknown, or other
gggggtgggggggggggggggtnntcattcgcttgttnncnttttttcntatcctttcaaaaaggcactccaccgcggtggcggccgctctagactagtggatcccccgggctgcaggaattcccacgagaccattacctagaacatcctattccaaaaatcagaaccgatccttacagagagacacacccagcgcgcgagatatcaacgtcgatcatcgtgaccagagagcgagaaggccaagcagcagcgatggcggcatacatgcgacgtgacgcatccgcgactaggaacgctaagacggtgacagagaagatgccggtcccggagacgcggccgcccggacacagtcagagcacttacaagcgctaatctgtagaagaacggttctccaccggcgttactcagcgggcaccccatgcgaaacacgccccccgagggccgcggggcattcggccggcccacggccctcccaaagtcccgggggcgccggacggcgaagtaacacaccctccgccaagggcgcccgcgagccagattttcgatatgaatcagacccagaacatcgcaaccccaggacaccccggcccggcgcccttccggccccgccagagcggacccccccaaacctatctcctaacgcacggcgcccccgaggctcacccccaaaccaccgcaacccccccgcaccccacaccccaataccaaaccctgtggcaccttcgccacgcaagcgtggcaaaagtcaaccgcttacgatcgcagcccgaagaaagcgcagactacctggccggaccgagcccaggggaacagagcagagaacggcaccatggcgccccatccagcccagatatcaacatg

SEQ ID NO: 39286 - DNA, 634 bp, Zea mays
  misc_feature: Ceres CLONE 1429124-F
  misc_feature: Translation starting site: 183
  misc_feature (472)..(472): n is a, c, t, g, unknown, or other
  misc_feature (558)..(558): n is a, c, t, g, unknown, or other
ggagctccccgcggtggcggccgctctagaactagtggatcccccgggctgcaggaattcgcacgagaccattacctagaacatcctaatcgaaaaatccatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgctctcgctcacagccgcgcgtcgtcgacggcggaacggcaggccacctgcaaactgctcagagcatgacgggccggctcggcggcngcgtcagcatgggcaacgccgccaacatcccctccaagtgcggcgtctcccgtcgggtgcccatcagccccacggtcgactgcacnaagatcaactgatcgatgggaccatagtggaggtagctcccccgttggatggcaacctaccgtggccatcaagaag

SEQ ID NO: 39287 - DNA, 654 bp, Zea mays
  misc_feature: Ceres CLONE 1429125-F
  misc_feature: Encodes the peptide sequence at SEQ ID NO. 39288
  misc_feature (489)..(489): n is a, c, t, g, unknown, or other
  misc_feature (497)..(497): n is a, c, t, g, unknown, or other
  misc_feature (541)..(541): n is a, c, t, g, unknown, or other
  misc_feature (566)..(566): n is a, c, t, g, unknown, or other
aagctggagctccccgcggtggcggccgctctagaactagtggatcccccgggctgcaggaattcgcacgagaccattacctagaacatcctaatcgaaaatcattccatcgtctttgctcgaggagtcgaggttcaggttccacggtgcggcgagagctagctcgcagccatggagagcaagagcccatggtcgctgcggctgctaatttgctgcgcggcaatggtggccatcgcgcttctcccccaacaaggaggccaggccgcttgtttcgtgccgacgccgggtccagctccggcaccgcccggctcctccgcgacgaacacgaacgcctcctccgctgctcctcggccagccaagcccagcgcattcccgccccccatgtacggtggtgtcacccccggcaccggcagcctccagccccacgagtgcggcggccggtgcgcgaagcggtgcttcgcaacggcgtaccagaagccgtgcctcttnctctgccngcagtgctgcgcggcgtgcctgtgcgtgccgcccggcacctacngcaaacagaacacctgccctgctancacactggaaagacaagcggggagcccccagtgccctagtagccctccctctcgtctacttgatgagatcttttgtcaaaaaatcaaa

SEQ ID NO: 39288 - protein, 161 aa, Zea mays
  misc_feature: Ceres CLONE 1429125-F
  misc_feature (47)..(144): Pfam Name: GASA Pfam Description: Gibberellin regulated protein
  misc_feature (106)..(106): Xaa is any aa, unknown, or other
  misc_feature (109)..(109): Xaa is any aa, unknown, or other
  misc_feature (124)..(124): Xaa is any aa, unknown, or other
  misc_feature (132)..(132): Xaa is any aa, unknown, or other
MESKSPWSLRLLICCAAMVAIALLPQQGGQAACFVPTPGPAPAPPGSSATNTNASSAAPRPAKPSAFPPPMYGGVTPGTGSLQPHECGGRCAKRCFATAYQKPCLXLCXQCCAACLCVPPGTYXKQNTCPAXTLERQAGSPQCPSSPPSRLLDEIFCQKIK

SEQ ID NO: 39289 - DNA, 720 bp, Zea mays
  misc_feature: Ceres CLONE 1429127-F
  misc_feature: Encodes the peptide sequence at SEQ ID NO. 39290
  misc_feature (695)..(695): n is a, c, t, g, unknown, or other
  misc_feature (702)..(702): n is a, c, t, g, unknown, or other
  misc_feature (703)..(703): n is a, c, t, g, unknown, or other
aaagctggagctccccgcggtggcggccgctctagatctcgtggatcccccgggctgcaggaattcgcacgagaccattacctagaacatcctaatcgaaaaatcacacagcttgcaaggcgccccatctctcaaaccatccgaacccccctcgccgctcactcccaagctaatccccgccggcagcgatggcccgcacgaagcagacggcgcgcaagtcgacgggcggcaaggcgccgcggaagcagctggcgacgaaggcggcgcgcaagtcggcgccggccacggggggcgtgaagaagccgcaccggttccgcccgggcaccgtggcgctgcgggagatccgcaagtaccagaagagcacggagctgctgatccggaagctgccgttccagcggctggtgcgggagatcgcgcaggacttcaagacggacctccggttccagtcctccgccgtggccgcgctgcaggaggccgccgaggcctacctcgtgggcctcttcgaggacaccaacctctgcgccatccacgccaagcgcgtcaccatcatgcccaaggacatccagctcgcgcgccgcatccggggcgagagggcctgagcacccccccgtctctgctgcgcttccttcgctttctgatttctgtagtgcgaagaactagtgcgtgttatattggggttggtgggtaggaaactnagaatgnntctgtgggtttcgatgc

SEQ ID NO: 39290 - protein, 136 aa, Zea mays; identical to SEQ ID NO: 6923
  misc_feature: Ceres CLONE 1429127-F
  misc_feature (58)..(132): Pfam Name: Histone Pfam Description: Core histone H2A/H2B/H3/H4

SEQ ID NO: 39291 - DNA, 646 bp, Zea mays
  misc_feature: Ceres CLONE 1429134-F
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagttttcttccattcaaccaactagctgcattgaactcttgcttctttatttgcaacaacaacaaactaccatttcagccaagctaccttgctgcccaaccccccaacaattttctttccatttcaaccaaactgggaagcatn

SEQ ID NO: 39292 - DNA, 677 bp, Zea mays
  misc_feature: Ceres CLONE 1429135-F
  misc_feature: Encodes the peptide sequence at SEQ ID NO. 39293
  misc_feature (371)..(371): n is a, c, t, g, unknown, or other
aagctggagctccccgcggtggcggccgctctagaactagtggatcccccgggctgcaggaattcgcacgagaccattacctagaacttcctaacgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctcaacgacaaggggccgacggcgtcgcaggcgctgacggtggcgacgctgttcccnctgggcgggctgctgctgggtgctgacaggctggcactgacgcctcccgtgtggggcctgccgtggaccccccggtgttcctgatcttcaaccccgtgctggtcccccgccgcgctgctcatcgggacgggcgtcatggggttcctcaccgtcgggccccctggggctcaggaggcctgtcctcccctaaggtggctccccaacacggcgcgggaagggtttcaaccccaccccggactaggtggaggaggcccacccgcaggatggcagaaggccccgccccaagcgggcccaaagaacccgcag

SEQ ID NO: 39293 - protein, 83 aa, Zea mays
  misc_feature: Ceres CLONE 1429135-F
MADRDRSGIYGGAHATYGQQQQQGGGGRPMGEQVKGMLNDKGPTASQALTVATLFPLGGLLLGADRLALTPPVWGLPWTPRCS

SEQ ID NO: 39294 - DNA, 611 bp, Zea mays
  misc_feature: Ceres CLONE 1429139-F
  misc_feature: Translation starting site: 315
  misc_feature (361)..(361): n is a, c, t, g, unknown, or other
tccccgcggtggcggccgctctagaactagtggatcccccgggctgcaggaattcgcacgagaccattacctagaacatcctaatcgaaaaatcaagtacccaaaccctttcgatctgctcaactaccaaactctgctcctccctgcttccgtcacgcgagagcactccactcccacgcgaaccctagcagtggttctccctcggggccccgctaagcagcttggttccaagctgtagaagcatctccgatcccatccgcggcgggttgaggccatcagctccggtttctgcagccggatttgggatccgcgagatgtcttggtccgcgcccgacgacatcctcctctccacctccctcgncggttttctggacacaaatgttgttcttcagggtgcttgtgacgagtgattgtggggaaacataatgtgatgttcctcttgggctgtacgtaatccggggagagaacgtgtttaatcggagaattggatcgcgaaagggatgactccctgctcccatgactggggttcagaagcaaaaatagaaaagctgaaaaggccgaccgggaacccaaaatttttaaggggaccaataaggaaacggatggatttc

SEQ ID NO: 39295 - DNA, 670 bp, Zea mays
  misc_feature: Ceres CLONE 1429142-F
  misc_feature: Pfam Name: LRR_2 Pfam Description: Leucine Rich Repeat
  misc_feature (670)..(670): n is a, c, t, g, unknown, or other
aaactggagctccccgcggtggcggccgctctagaactagtggatcccccgggctgcaggaattcgcacgagaccattacctagaacatcctaatcgaaaacaaattgatgataagggcagtgaatggatccacgatctcgcagtctgctgtcctgttctgacaacattgaatttccacatgactgaccttgaagtgatgccagctgacctaaagcttcttgcaaagagctgcaagtcactgatttcattgaagattagtgactgcgatctttcagatttgatagagttcttccaatttgccacagcactggaagaatttgctggagggacattcaatgagcaaggggaactcagcaagtatgtgaatgttaaatttccagtcaagactatgctccttgggacttacttacatggaaacaaatgaaatgcccattatgttccctttttctgcaaatactaaagaagctggatttgcaatacactttcctcaccactgaggaccattgccagctcattgcaaaatgcccgaacttactagttctcgcggtatcatctcctgctcatgtaaattatgaagatactgaattggcaatcttttcatggtaattgacagtatatttcctccgtatagtgaggaatgtgattcgatatagacgattacgagttgtn

SEQ ID NO: 39296 - DNA, 671 bp, Zea mays
  misc_feature: Ceres CLONE 1429146-F
  misc_feature (463)..(463): n is a, c, t, g, unknown, or other
ggagctccccgcggtggcggccgctctagaactagtggatcccccgggctgcaggaattcgcacgagaccattacctagaacatcctaatcgaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccgaagagcacaccgtccccacccccatgtttacccaccagttcctctgacgggcgccgtgctccgatgaagctgagcgtgctccgtaaatcgcgctcccactcctttnctcgtcgcttcctctactggttctacgtcttctcatgaacgcatcgcccctctcaactgctgatccttcggcgtctctccctctctctttctctctgagatagtctttcgaaatcatctctagggctcctgtttctcccatctttcccccacccaacccccaccaaaaagattctatccaaaaaacaagcttccttggcttcctcccc

SEQ ID NO: 39297 - DNA, 854 bp, Zea mays
  misc_feature: Ceres CLONE 1429153-F
  misc_feature (854)..(854): n is a, c, t, g, unknown, or other
ttgtgtatttttttttatttactctagcgcactgcaaacagaaccacaggggcaaaaaaaatggaactccacgcgggggcggccgctctagaactagtggatcccccgggctgcaggaattcgcacgagaccattacctagaacatcctaatcgaaaactgcacacattccgcgcacaccccgggagccgtggacgccttcgccgtcgcgtcccgctcctccgcccgcccgacgcgacccctaggacctggagagagaggtcggcatggctgccgcaggggtcgacgacactgggagggacaccgtccagaagcgcgtcatgccaccagacgaacgccttttggtggacaaggataaccatgttgttggccatgaggtgaaagtgcgactgccggtgtgaccggagagggttgactcgtgaggacatcctgctggcatagggcaatctcgggggcagtttccatattgcggcacaataaaatggagcctgcgtactaccagggggagggaagcacaaaggaaagaggggcggctgttcactttgtgggtctagggaggggggaaacttggctgggcgaacacgcccacggcgggaaaacacgtggggggaaaagaagccggtgtgcccggcgaaggaaccatccccttcgaccggtcggaaaaaaagaaaaggcaacaaggggggaaggccaacctggggggggaaaaatggggacaagcctgagagtggggaggaggggccccccaaatcggggagcaaaggaacgacgccaaaccccaggcgcagcagaagcactcttaacggcggggccacaaccctttgacggcgcggaaaaaaagagcgggaggagacn

SEQ ID NO: 39298 - DNA, 660 bp, Zea mays
  misc_feature: Ceres CLONE 1429155-F
  misc_feature: Encodes the peptide sequence at SEQ ID NO. 39299
  misc_feature (471)..(471): n is a, c, t, g, unknown, or other
gctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgcccggctgcaggaaccctgaggagatcccgtggggttcggttggtgctgaatatgttgttgagtctactggtgttttcactngaccagaagaaggctgcagctccacttgaaaggtgggtgccaagaaggttggtcatctctggctcctaacaaagatgccccccatgtttgtccgtttggtgtccaacaagaaaggaagtaccaaggcctgaacattaaacattttgcctccccaaggctatggggggcaaaaacccaaattggcctttg

SEQ ID NO: 39299 - protein, 114 aa, Zea mays
  misc_feature: Ceres CLONE 1429155-F
  misc_feature (4)..(111): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (106)..(106): Xaa is any aa, unknown, or other
MAKIKIGINGFGRIGRLVARVALQSDDVELVAVNDPFISTDYMTYMFKYDTVHGQWKHHEVKVKDSKTLLFGEKEVAVPGCRNPEEIPWGSVGAEYVVESTGVFTXPEEGCSST

SEQ ID NO: 39300 - DNA, 720 bp, Zea mays
  misc_feature: Ceres CLONE 1429156-F
  misc_feature: Encodes the peptide sequence at SEQ ID NO. 39301
aagctggagctccccgcggtggcggccgctctagaactagtggatcccccgggctgcaggaattcgcacgagaccattacctagaacatcctaatcgaaaagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgcccctgacggtcgatggcgcgggtggcgctccggttgggcgcccgcgcgctcgcggttctcgtcctcgtgtcagtggctctgcttccacttgtcagttccgacgatggacacatactctgcgagggtgttgtcaggtgctgggcggattcctccactgagcgcgtgaaggacggtgacaaactgagcctctaggatttgctcttctgcactcacattgctaggactggaggccgcacctactttcactgcttcctaaaaaagctgtatacaaatgcgcaggaatgcccgcgttcttatgacgaac

SEQ ID NO: 39301 - protein, 59 aa, Zea mays
  misc_feature: Ceres CLONE 1429156-F
MARVALRLGARALAVLVLVSVALLPLVSSDDGHILCEGVVRCWADSSTERVKDGDKLSL

SEQ ID NO: 39302 - DNA, 712 bp, Zea mays
  misc_feature: Ceres CLONE 1429172-F
  misc_feature: Encodes the peptide sequence at SEQ ID NO. 39303
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaaagccttccccgtctctcctcttctgccgaacgagacagaccgggttatgtagcctgcctcgctttcggcgagagaggaagaggcggaggagatcagggcaatgggcggggcggaggcgctgggccagccggacggccatgcgaacggggccgtggtggaggagaagctggacttgctgcggcggcagctggggaaggcggacggcgacccgctccggatcgtcggcgtcggggcgggcgcctggggtagcgtcttctgcgcgctgctgcaggacgcgtacggccacctccgcgacaaggcgcaggtccgcatctggcgccgcccgggccgagccgtcgaccgcgccaccgccgagcacctcttcgacgtcatcaacgcgcgcgaggacgtcctgcgcccgctgatcccgcgctgcgcctacctcaagtacgtcgaggcgcgcctcggcgaccgcacgctctacgccgacgagatactcagggacggctnctggctcaaacatgatggaaacgcccgtttttgccgtttaagggtgtccccaaccttgcaggaagcccttctcgggacccctaaattttttggtaaaagggccgggcttttccccgaacaa

SEQ ID NO: 39303 - protein, 170 aa, Zea mays
  misc_feature: Ceres CLONE 1429172-F
  misc_feature (130)..(130): Xaa is any aa, unknown, or other
MGGAEALGQPDGHANGAVVEEKLDLLRRQLGKADGDPLRIVGVGAGAWGSVFCALLQDAYGHLRDKAQVRIWRRPGRAVDRATAEHLFDVINAREDVLRPLIPRCAYLKYVEARLGDRTLYADEILRDGXWLKHDGNARFCRLRVSPTLQEALLGTPKFFGKRAGLFPEQ

SEQ ID NO: 39304 - DNA, 858 bp, Zea mays
  misc_feature: Ceres CLONE 1429173-F
  misc_feature: Encodes the peptide sequence at SEQ ID NO. 39305
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (858)..(858): n is a, c, t, g, unknown, or other
nggggnnnnccccccccccccccccgccgcccgnnnnnnnnngnnnnnnngagtgtggcgcgcaaaactgggagctccaccgcggtggcggccgcctctagaactagtggatcccccggggctgcagggaattcgcacgagaccattacctcagaacatcctatatcgaaaagttcggacttaccgccgcagcttcgcccatctcgctccagccgtcttcacagcgaccgccgtatcgcctcatccgactgccgtcgagaatgccgttcaagaggctctgtggagatcgggcgcgtggcctcttgtgaactacggccaagactacggccgcctcgtcgtcatcgtcgatgtggtcgaccagaacagggcacttgaggacgcccctgatatggtcaggtggcaagattaacgttaaaaaggatactcacttaccgacatctaagattgacaatcaaacggtgtccccgaagaagtcaaccctttgacgcacgggctactggagggaagcctccaccctcgcagtactaaggcggggaggaaacagtttcactgcggggcaaggtaagcctcgatcggtcccccgcaaatagggaagggtctaggccctatcgagtggacctcccgcacccgggcatcacaggggcccatgcctgggcgtaaggtatctaagtcaagggcgcggtgggctaatccaggagaaaagaaagcttctccctccagactcgaaagtaaaggacgctccaactggcgtctaaaagatcacgctttcttcgcgtgtgcaatgaaatcttttgtccaagacactcgcacgtaaaaacaagtagggtgtatagtgaaatacatgggggaaactggtgn

SEQ ID NO: 39305 - protein, 135 aa, Zea mays
  misc_feature: Ceres CLONE 1429173-F
  misc_feature (2)..(2): Xaa is any aa, unknown, or other
  misc_feature (3)..(3): Xaa is any aa, unknown, or other
  misc_feature (12)..(12): Xaa is any aa, unknown, or other
  misc_feature (13)..(13): Xaa is any aa, unknown, or other
  misc_feature (14)..(14): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
GXXPPPPPAARXXXXXXVWRAKLGAPPRWRPPLELVDPPGLQGIRTRPLPQNILYRKVRTYRRSFAHLAPAVFTATAVSPHPTAVENAVQEALWRSGAWPLVNYGQDYGRLVVIVDVVDQNRALEDAPDMVRWQD

SEQ ID NO: 39306 - DNA, 664 bp, Zea mays
  misc_feature: Ceres CLONE 1429179-F
  misc_feature: Encodes the peptide sequence at SEQ ID NO. 39307
  misc_feature (448)..(448): n is a, c, t, g, unknown, or other
  misc_feature (582)..(582): n is a, c, t, g, unknown, or other
tccccgcggtggcggccgctctagaactagtggatcccccgggctgcaggaattcgcacgagaccattacctagaacatcctaatcgaaaaaaggcaacaagggagaagtagatctgcatctgcgagagaaggcagcgggggtggtgatgatggagagccagccgctgcaggccccgacggccacggctccggcccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccctccaagacaatcccctatgtatggaccgtctttaccgctggttacatcgagcaagtcctcccaggggccattgggcagtctcttggtcttctctttttgnggaaggacattgaaccagcatggggccgcaaggaattcttgagagtcattattttgaacaactccctcctgggggatttcttgggggttttttttttttcccccccgcgggggcggaacacctaatcccccccngccccaggaaaaaggagaaaaaaaaacgtgttcccctccccccaacccccccccccccttttttgtggtttgcggggggggg

SEQ ID NO: 39307 - protein, 141 aa, Zea mays
  misc_feature: Ceres CLONE 1429179-F
  misc_feature (67)..(138): Pfam Name: DUF1751 Pfam Description: Eukaryotic integral membrane protein (DUF1751)
  misc_feature (101)..(101): Xaa is any aa, unknown, or other
MMESQPLQAPTATAPAPGSAEPAGAPPAVTPGKEFTRTCKGLVVVLIGGYVLLQLLPSSLNYLAIIPSKTIPYVWTVFTAGYIEQVLPGAIGQSLGLLFLXKDIEPAWGRKEFLRVIILNNSLLGDFLGVFFFSPPRGRNT

SEQ ID NO: 39308 - DNA, 668 bp, Zea mays
  misc_feature: Ceres CLONE 1429180-F
  misc_feature: Encodes the peptide sequence at SEQ ID NO. 39309
  misc_feature (341)..(341): n is a, c, t, g, unknown, or other
  misc_feature (355)..(355): n is a, c, t, g, unknown, or other
  misc_feature (367)..(367): n is a, c, t, g, unknown, or other
aagctggagctccccgcggtggcggccgctctagaactagtggatcccccgggctgcaggaattcgcacgagaccattacctagaacatcctaatcgaaaaacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctnggttcggatcaccnggtggcatgaangggtgaggggctgaccgttgaccagtccgccccctaacccctgcctatgccttgcggcccaagaaatccccaaaggccttcaaaggggctttgggttttccggccccggccaaatataactctcccggccccccgggagggaaaaaaaacaaaaacaccccggagactgtggggccccttttccccccccgggggggttttttttctttcgggggagaaaaaaacaccccccccttgtggggagctttttcccccccccgccccccccgggaagaacacccctcaagaaaaaagggggggg

SEQ ID NO: 39309 - protein, 59 aa, Zea mays
  misc_feature: Ceres CLONE 1429180-F
  misc_feature (57)..(57): Xaa is any aa, unknown, or other
MSRRKTREPKEENVTLGPTVREGEYVFGVAHIFASFNDTFIHITDLSGRETLGSDHXVA

SEQ ID NO: 39310 - DNA, 737 bp, Zea mays
  misc_feature: Ceres CLONE 1429187-F
  misc_feature: Encodes the peptide sequence at SEQ ID NO. 39311
  misc_feature (737)..(737): n is a, c, t, g, unknown, or other
aagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggagggcaagggggcgagagcgtgagtccaacgccggcgctcgggctgctctgcttccggaaggagatgctgacgcgctgctggagcagatggatggcgatatgcgcgccggctctggtgtcgttcctgtcgcgctgaacaagggtatccaatgaagtcggatggtgtggcgtttagattccctccctgatcatctcaggtggctaatgcaattaagttgatgcn

SEQ ID NO: 39311 - protein, 148 aa, Zea mays
  misc_feature: Ceres CLONE 1429187-F
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGGESVSPTPALGLLCFRKEMLTRCWSRWMAICAPALVSFLSR

SEQ ID NO: 39312 - DNA, 702 bp, Zea mays
  misc_feature: Ceres CLONE 1429191-F
  misc_feature (445)..(445): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttcaaccctacaggatccaacaggcaatcgcagctggcatcttacctttatcaccccttgtcctccaaacatcatcagccctattacaacagttaccttttgtgcatttattggcacaaacatcagggncacacactacaaacactgtgctagaaacctttgctgctactctcagaacagaagtttcttccatccaccaactaggtcattgaactcgcttcttattggaaacaaaaaaattacatttagccggtttctgggtgcctacccccagaatttttttcctttccaccaaggggaaaatgtaacccccctggattttttcccagggaaaatttttcccttttcccccntttttggggggggcccccttcatcctttttaaa

SEQ ID NO: 39313 - DNA, 605 bp, Zea mays
  misc_feature: Ceres CLONE 1429196-F
  misc_feature: Encodes the peptide sequence at SEQ ID NO. 39314
  misc_feature (382)..(382): n is a, c, t, g, unknown, or other
ctggagctccccgcggtggcggccgctctagaactagtggatcccccgggctgcaggaattcgcacgagaccattacctagaacatcctaatcgaaaagattgggtccaacaccagccgccgccatgtcgaagcgaggcaggggaggttcggcggggaacaagttccgcatgtcgctgggtctgccggttgccgcgacggtgaactgcgcggacaacacgggcgcaaaaaactctacatcatctccgtcaaggcatcaggggccgctcaaccgcctccgtccgctgcgttggcacatgtcatggccaccgtcagaagggaagcccgactcaggaagagggatgccgccgtcatctccgccagccagcgtggccccaaagacngttctactgtactcaaaatatgctgaatgatgtgatccccaggtgagataaaagtccctatcctgactatcggaagaatggctatctttgccctagattctacccaccaacccatcctttagaacttgttgaattggtcaaattcaaataacctcttattccacttccaaaaggctatgggctaatgggccttttttttttccccccatttgtagaaaaaaaa

SEQ ID NO: 39314 - protein, 95 aa, Zea mays
  misc_feature: Ceres CLONE 1429196-F
MSKRGRGGSAGNKFRMSLGLPVAATVNCADNTGAKNSTSSPSRHQGPLNRLRPLRWHMSWPPSEGKPDSGRGMPPSSPPASVAPKTVLLYSKYAE

SEQ ID NO: 39315 - DNA, 701 bp, Zea mays
  misc_feature: Ceres CLONE 1429206-F
  misc_feature: Encodes the peptide sequence at SEQ ID NO. 39316
  misc_feature (481)..(481): n is a, c, t, g, unknown, or other
  misc_feature (484)..(484): n is a, c, t, g, unknown, or other
  misc_feature (536)..(536): n is a, c, t, g, unknown, or other
aagctggagctccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatgggcagccttttgttgatgtcctcaaggagggaggcgtcctccctggcatcanggnttgacagggcaccattgaggttgttggcactgataaggagaccaccacccanggccatgacgaccctgggcaagcgttgcgccaagtactacgaggcaggtgcccgctttgccaggtgcgcgctggtctcaagatggccctaatgagccatcacagcttgccatcgacctgaacgctcagggtctggctcgctatgccatcatctgcaaggagatgg

SEQ ID NO: 39316 - protein, 102 aa, Zea mays
  misc_feature: Ceres CLONE 1429206-F
  misc_feature (11)..(105): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFEETLYQKTKDGQPFVDVLKEGGVLPGI

SEQ ID NO: 39317 - DNA, 649 bp, Zea mays
  misc_feature: Ceres CLONE 1429207-F
  misc_feature (335)..(335): n is a, c, t, g, unknown, or other
  misc_feature (338)..(338): n is a, c, t, g, unknown, or other
  misc_feature (359)..(359): n is a, c, t, g, unknown, or other
  misc_feature (363)..(363): n is a, c, t, g, unknown, or other
  misc_feature (364)..(364): n is a, c, t, g, unknown, or other
  misc_feature (392)..(392): n is a, c, t, g, unknown, or other
  misc_feature (393)..(393): n is a, c, t, g, unknown, or other
aagctggagctccccgcggtggcggccgctctagaactagtggatcccccgggctgcaggaattcgcacgagaccattacctagaacatcctaatcgaaaagtagtgggcactgtcgtgtgcccacgcacagtcacacggacatgttaatcctcttcccctggtgaggtctcgcggcggcgggcaatccattcgacgatcccaatggcggcctcgtcgtcgttcaagccgaacccgctgtcgctgagcgtgccggacccccgcgctcgaccgctggctccgggacaccggtttactcgacctcctcgactccaaccccaccggaggggcgtcttnagnctaagccccctccacttcaancccnnccccggccccgaattggtggggggtccnnttaaaatccttgcctttggggggacctttgctttggtctttggggttaaacccctttgggggcctttccccccccaaattgggccccccccccccttccggggcgttttgccttcaaaaggaccccccggggcccggtttttttttttgggcccccccaccccccagggagaagtttccccttaaaaaaaaaaactccccgggtaagagggcaaaaaaaccccccggtcaaaaacccttttttttggggggggggg

SEQ ID NO: 39318 - DNA, 688 bp, Zea mays
  misc_feature: Ceres CLONE 1429212-F
  misc_feature: Translation starting site: 196
aaagctggagctccccgcggtggcggccgctctagaactagtggatcccccgggctgcaggaattcgcacgagaccattacctagaacatcctaatcaaaaacttttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactcccagaagcggttcggcaaggcgcagtgccccgatcgttgagcgccttacaaactccctcatgatgcacgggcgccaacacccgcagaaaggcatggctgtccgcatcatcaagcataccctggagatcattcacctgctcaccgatgcccaccccatccaggtcgtcgtcaacgcaatcatcaacagtggcccccggggaggatgccacccgtattggttcccctggttgttggaagaaggcaggcccttgtatatccccccccctgaggagggggaaacagggcattctacctcctcaccacgggggccggggagaagggctttcaggaaaatcaaa

SEQ ID NO: 39319 - DNA, 756 bp, Zea mays
  misc_feature: Ceres CLONE 1429213-F
  misc_feature: Encodes the peptide sequence at SEQ ID NO. 39320
  misc_feature (30)..(30): n is a, c, t, g, unknown, or other
  misc_feature (37)..(37): n is a, c, t, g, unknown, or other
  misc_feature (47)..(47): n is a, c, t, g, unknown, or other
  misc_feature (58)..(58): n is a, c, t, g, unknown, or other
tttttttttttttttttttttttctgtctnacctgtnccaacccagnaggaccctccnccacaagctgggactccccgcggtggcggccgctctagaactagtggatcccccgggctgcaggaattcgcacgagaccattacctagaacatcctaatcgaaaaatcatcactgccatctctctctgactctgtgtccgtctctaaactctagtctgtgcgaatctgctgccagcagcgaggaacagaacagtagccaatttgccatctcacagttgcgttcctccgattccccgtcccccgatggacctgtctcccagctcgtcggcgccatccgcgccgccggtgccgtgcgagtggtccggcgccgggctcggctccgcggcgtgcggcctcacctgcagggtgctctgcgccgtcgccacctgcgtcttcccggccgtggggtccctggtcggggcggtgacgggttccatcgccgggctggtgaccgagagcggtatgctgcgcggcgccgggattggggccaatctccgggcggccgtctttcccaagcgaggaccgccgagtcgtccccgccaacctcttggcactccgggccaactcgccggggtcttgggacccctcctcctacactggggggggacaaccaaccccccggggcaaacatagagccgtggcttggggtgttgatctccggaaaaaaaagcgtgggggccccgcgccatattctaaaaaagtgggccattgggaggaag

SEQ ID NO: 39320 - protein, 122 aa, Zea mays
  misc_feature: Ceres CLONE 1429213-F
MDLSPSSSAPSAPPVPCEWSGAGLGSAACGLTCRVLCAVATCVFPAVGSLVGAVTGSIAGLVTESGMLRGAGIGANLRAAVFPKRGPPSRPRQPLGTPGQLAGVLGPLLLHWGGTTNPPGQT

SEQ ID NO: 39321 - DNA, 682 bp, Zea mays
  misc_feature: Ceres CLONE 1429214-F
  misc_feature (266)..(266): n is a, c, t, g, unknown, or other
atagctggagctccccgcggtggcggccgctctagaactagtggatcccccgggctgcaggaattcgcacgagaccattacctagaacatcctaatcgaaaaaaatcagaagggaaacacaggaacgacaggcaattcgaggcgggcaatctaatcgtctgccatcccgtctcatcgttctcccaaatctgagagcgttcccaggacctagggttcttgagatccagccccaggatggatccgaaccctagagctcccctcctccntcgcatcgtcgttctcgcgctttgcgtatccgtggtgccagcgccgaggacgacgcgtccggggtctctctgggccgccgcgccggggggttcttgcacggccttaaaaaagatgcccttggccgagggcaatcatggggttggccctacacaaagttgggaccgggggctgttccacccccttctttccccccccctccatgaacctagtcagggaaatttggaataaaaccctctcttatttcctccccctaatggctattccccccccccaaggtaatttgttttgttctggtcgacctttcctgccctttttttggaagaaacccattttggcccccctggaccttttgaaaaaaaatccccccccactttttgttttcccgggggaaccccccttttttgttgtgtctccc

SEQ ID NO: 39322 - DNA, 723 bp, Zea mays
  misc_feature: Ceres CLONE 1429222-F
  misc_feature: Translation starting site: 194
  misc_feature (612)..(612): n is a, c, t, g, unknown, or other
  misc_feature (723)..(723): n is a, c, t, g, unknown, or other
aagctggagctccccgcggtggcggccgctctagaactagtggatcccccgggctgcaggaattcgcacgagaccattacctagaacatcctaatcgaaaaaccccgacggtgaattccccattcacatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcaggcagcagtgcgtccaggcttgcgagcgccggcgacagcagcgcggcggcagccgtgactccaacgtcgacgaggacgacagcgaccggcggtgccagatgaaatgccggcgccacagcgatcggcaggcgaggcagtggtgcgtgcagcgctgcgagcgtaagcaacaggaggaagacgccgccgccgacgacgacnacagcggccggtgccagaagagatgccagcaccacagcgatcggcaggcgaagcagtggtgcgtgcagcgctgcgagcgtaagcacaggaggacgccgccgccgagacgan

SEQ ID NO: 39323 - DNA, 671 bp, Zea mays
  misc_feature: Ceres CLONE 1429223-F
  misc_feature: Translation starting site: 324
aagctggagctccccgcggtggcggccgctctagaactagtggatcccccgggctgcaggaattcgcacgagaccattacctagaacatcctaatcgaaaactcccaccgtcccacgttgttcctcccgaccctcgccgtccctcccggcgcgacccgtcctcctcctcccgaccacgccgcccagcgccgtgtaccactccctcccagcctcgccctcgcacgccgtccctcccgccgtgacccttcctcctcctcccgacctcgccgcctagcccgtgtcgtcgccggcccccgtgccactctgctgctgctaccacgataatggggatgtggaaggtggtgtgcgtcccaactcatcatcgtacatcgcgtcctggatcgtcaggctcctcctcgaccgtggctacctcgtccgcgccaccgtgcgagacacagagccgacctcacttgatctattcaagaacttccattatcgcgcagacaatggatttaccgagtttgtacagaaagcacattgatgatatggaaggcatcatgagctgaaccagtacaagatggacatgaaccattgttagcagatgctgctgtttctcacgctgtcataaccaactacttttctatcggtagcaggtgactgttctgcctctaagagtacctctagagtgctac

SEQ ID NO: 39324 - DNA, 656 bp, Zea mays
  misc_feature: Ceres CLONE 1429230-F
aaagctggagctccccgcggtggcggccgctctagaactagtggatcccccgggctgcaggaattcgcacgagaccattacctagaacatcctaatcgaaaaattccactccatcagtgggcagcgctctgctctcctcactcactcactccccttgcccccatccatccgctagccactagctccagcaggctcgccgccgacactccactagtgctctgctctctccgctccactacaaactcccctcgctcccccccccccccccaatcggcgatggatctgctgctgcggcggcggctgctggccctggtggccacggcggcggtgctggcctttttccccctcacggggggggaggggttcaacatccctgagaatccggggaagacacaacaaatttctccatttttgaaaattgctaaaagaaacccaacgtggccgggaaattaacccgcgaccccaaaacaccggggtgggccggggcaaagggaaaaaagggccacctccgccccgggaaaaaattggttgggaaccatccccaaactcccaaagtgaacgtgcgcccccgaatttttacaaaaaaaaaaaagccccacccgttttgtccacccccccccccccccccccgaccacctttttataccaaaaaaaaa

SEQ ID NO: 39325 - DNA, 729 bp, Zea mays
  misc_feature: Ceres CLONE 1429231-F
  misc_feature: Encodes the peptide sequence at SEQ ID NO. 39326
aaagctggagctccccgcggtggcggccgctctagaactagtggatcccccgggctgcaggaattcgcacgagaccattacctagaacatcctaatcgaaaatttttcgacaacgccaaacatctggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaggattgcgtgatgcaattgctgctgggatcacctcacgtgacggattccctgcaaatgcagatgacattttcatacagacggagcaagtcctggggtccacatgatgatgcaattactgattaggaatgaga

SEQ ID NO: 39326 - protein, 153 aa, Zea mays
  misc_feature: Ceres CLONE 1429231-F
  misc_feature: SWISSPROT Homolog: EC 2.6.1.2 Alanine transaminase
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRDGFPANADDIFIQTEQVLGST

SEQ ID NO: 39327 - DNA, 652 bp, Zea mays
  misc_feature: Ceres CLONE 1429233-F
  misc_feature: Encodes the peptide sequence at SEQ ID NO. 39328
ggagctccccgcggtggcggccgctctagaactagtggatcccccgggctgcaggaattcgcacgagaccattacctagaacatcctaatcgaaaagtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgctttcttcccatatacgcccttcaatgtgctcggggaaagggtgtgtttttcccttatgatggcagtaggttcctatgagagaacctggttatagtgctccgggaaccgggatcctattttgattatgccagtcctgggacaatcacctaaaatcccccaggcccctcttttggcccccggc

SEQ ID NO: 39328 - protein, 129 aa, Zea mays
  misc_feature: Ceres CLONE 1429233-F
  misc_feature (10)..(129): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFLPIYALQCARGKGVFFPYDGSRFL

SEQ ID NO: 39329 - DNA, 664 bp, Zea mays
  misc_feature: Ceres CLONE 1429247-F
  misc_feature: Encodes the peptide sequence at SEQ ID NO. 39330
  misc_feature (354)..(354): n is a, c, t, g, unknown, or other
  misc_feature (405)..(405): n is a, c, t, g, unknown, or other
  misc_feature (476)..(476): n is a, c, t, g, unknown, or other
  misc_feature (481)..(481): n is a, c, t, g, unknown, or other
  misc_feature (484)..(484): n is a, c, t, g, unknown, or other
  misc_feature (529)..(529): n is a, c, t, g, unknown, or other
ggagctccccgcggtggcggccgctctagaactagtggatcccccgggctgcaggaattcgcacgagaccattacctagaacatcctaatcaaaaaatctctagccagcgtcgtcggctgacctcctaccgtcgtcatggcttctcttcacccgttgatcgctgctgcgctcgtagtcgcggcggcctccacggcagcggcggcggcgagttgggcggcaccgtcgtcgccagcacgccctctgttccgcgagtacatcggcgcggaagggcagaacgtgacgttcgcggacgtgcccgtgcaccccgggcgtgaacttcacttcatcctctcctttcgcatcgactacggcgngaaaacgcacaacgccctccgcgcggcggtgcccacgaacggccgctttcnccgtgttctgggacgaaggcgaaactcaccccggcccgccgtggccgcccttaagtgcccctcctcccacngccgngtngggcttagcctcgggggcgacaccgtgttccgcgccaaacgcacngttccgcgcgtcctcccgtcgacgcctgggtcgggaacgccttggggtcctcggggccatcctcacccgctacggcctcgagggggtgaacgtgaactacaaccactttcgggaaggccagacccccgaggtgtt

SEQ ID NO: 39330 - protein, 176 aa, Zea mays
  misc_feature: Ceres CLONE 1429247-F
  misc_feature: SWISSPROT Homolog: EC 3.2.1.14 Chitinase
  misc_feature (73)..(73): Xaa is any aa, unknown, or other
  misc_feature (90)..(90): Xaa is any aa, unknown, or other
  misc_feature (114)..(114): Xaa is any aa, unknown, or other
MASLHPLIAAALVVAAASTAAAAASWAAPSSPARPLFREYIGAEGQNVTFADVPVHPGRELHFILSFRIDYGXKTHNALRAAVPTNGRFXRVLGRRRNSPRPAVAALKCPSSHXRVGLSLGGDTVFRAKRTVPRVLPSTPGSGTPWGPRGHPHPLRPRGGERELQPLSGRPDPRGV

SEQ ID NO: 39331 - DNA, 631 bp, Zea mays
  misc_feature: Ceres CLONE 1429252-F
  misc_feature: Encodes the peptide sequence at SEQ ID NO. 39332
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaatagcatctgcctacctgcactggactcaaaaacatgcctgccgtaggatcctgtgatgtgtccattcgcgtgttgagtcggcggcttgtgaaggcatccgacccctccctccagccgcacgtcgtcaccttctcaaacctagatctctacccggacaacgtgcaggcctccatagtgtgcctctaccccaagctgtcaacaaagtccggcccggggcgcggcttcgacgccgtcgtctccacctttcgaggcgtcctgccgaccttgcttaaccacttctaccctctcngcggtcgcattgtcgtcaacccaaagctcggcggtcccgaagctcactgccaccaccaggggcgcgaactcctggtggggaaaagtcggcctcccccctgggcaccctggattacggtcttgccaaggaatccctaaaaaaaaatcttgatgcccttaccctgaggaacctcccccttcctcggggcaagttggttgtcctttcggggggggggggtttttcccgggtggtgggggcca

SEQ ID NO: 39332 - protein, 130 aa, Zea mays
  misc_feature: Ceres CLONE 1429252-F
  misc_feature (86)..(86): Xaa is any aa, unknown, or other
MPAVGSCDVSIRVLSRRLVKASDPSLQPHVVTFSNLDLYPDNVQASIVCLYPKLSTKSGPGRGFDAVVSTFRGVLPTLLNHFYPLXGRIVVNPKLGGPEAHCHHQGRELLVGKSRPPPWAPWITVLPRNP

SEQ ID NO: 39333 - DNA, 645 bp, Zea mays
  misc_feature: Ceres CLONE 1429254-F
  misc_feature (622)..(622): n is a, c, t, g, unknown, or other
acccgcggtggcggccgctctagaactagtggatcccccgggctgcaggaattcgcacgagaccattacctagaacatcctaatcgaaaaacaaacccaacttccaccagacccctaaccttttcgcagctccagcgcacagccgccgccgtttcttcatcttcttcgcagagccggcgctccatcttcggctccctcccttacttgcgctcggcacgcaggcggcgctgtggctcgggatctcagtgacggcatcaagggcttcccctcccgcctctcgccagtcgcctccggtcctccgcacaccggccggtgatctctctcctcccgcctccggtggatcgtcaacggcgcccggccccggcggctgcgtcgcgcgcgtcctgagggcagctgcaggcgctgctcgactaaggcggtcgcgccgctttgggagcggtttatgccccaaagtgaagcgtgctcttagtgccgctctttggaaccctggtaatggctactgctgttaaatggctcaaccttcagtcattctagcaactgcaagttatgatcacacaatcagattttggggaagccaggagcggtcgctgttaccgcactatccagtatccagactctcaangtaatcgccttggagataccccc

SEQ ID NO: 39334 - DNA, 706 bp, Zea mays
  misc_feature: Ceres CLONE 1429256-F
  misc_feature (201)..(201): n is a, c, t, g, unknown, or other
  misc_feature (280)..(280): n is a, c, t, g, unknown, or other
  misc_feature (345)..(345): n is a, c, t, g, unknown, or other
tggagctccccgcggtggcggccgctctagaactagtggatcccccgggctgcaggaattcgcacgagaccattacctagaacatcctaatcgaaaatgactcagccaccgcgttcctcgaacgtgtcgtccgtgtagcatccatagagacccgtccacgcaaacacctcagcgatccaccgccctccctcttcgctaaangcgtaatccgaaatccgcccccagacccagatggcacgacgcaaccgatcccccaaatcccaaaatcttccagttcccntccctccgctcgacccagatcgaggcctcgatccaccggccatggcgctggagtgggtggtgctnggctacccggcggggggcggaaggcggtcatgcttgctgctgctaacgcttgcgggggctggaccgccctggcgcgggggaatgggtctcccggggtggggaagccccccttcaagcccattgaggggcgggggggggcccttctggcctctttccggggtcaagggaacatcttactgggagagatacaaggacgcgggccccacccttgcaaaagaaaaaaagaaaccccttgcccccccccttctcggaaggccccctctcccccaacccacaaaggttccggttcatggaaaaattccaagaggggaaaacccgtttttttctttaattgggcgcgccgtggtttttctttcttttt

SEQ ID NO: 39335 - DNA, 631 bp, Zea mays
  misc_feature: Ceres CLONE 1429267-F
  misc_feature (531)..(531): n is a, c, t, g, unknown, or other
aaagctggagctccccgcggtggcggccgctctagaactagtggatcccccgggctgcaggaattcgcacgagaccattacctagaacatcctaatcgaaaaaacaacggtcaagggcctagctatttgttaactctggcccctcacctgctccccttctgtccagcccacgggagggcgactagggttaggggcgaccggaggtccccgcgcctgcccaaatccacccatcccttccgttcaagccgccggagctcccaggccgctggtgtcgaagccgtcgccccttccttccaggcccgcctcctctctgtccgttctgtcttggtcgccgaagctcaagaccacagtgtcagggaagttctccaatcttccagcaaaacacaattcatcagtcagatacactttgacccgagaattattcagaatcactccacgagaggatcagctttcgaagctagagaagcagagctctaccaaacagggcaggacgtctctcaaatccccagttcagtaactggctaactgtangaaaagggaaaaaaagattgaaaaaccgccggccctaaaaggcaacctccccccaaaaaaagaaaaaaaaatttttctccctgaaaacaaagctggggga

SEQ ID NO: 39336 - DNA, 637 bp, Zea mays
  misc_feature: Ceres CLONE 1429272-F
  misc_feature (439)..(439): n is a, c, t, g, unknown, or other
  misc_feature (577)..(577): n is a, c, t, g, unknown, or other
aagctggagctccccgcggtggcggccgctctagaactagtggatcccccgggctgcaggaattcgcacgagaccattacctaggacatcctaatcgaaaaaggagcccagtcaatgagcttagcacttctcgagggctactcctccgcctaggaggaggacggccccgccgccggcgccggcgccgagctaagcgagtccgctgattcgtcagccgaggaagccggatcggacggcgacgaggggtccgctcctccgaagtcggccttcaagccccgccgccgaccaaaccgtaagaagggagatgccggcggcggcgacggggactcctgtctgccctccgctctggaggccttctccgatatctcgggaccaccggagttcttgaggcacagggttgcggagcctgaggaagggacggaggccctcggtgtactcnatcgccgtgggaaagaggggagcaagctgccgcctccaggagctgttgtggtggcaaaaccgcagttggttaccacaattggagccaaccctccaggttcagtgacatctggttctgttgatggaaaacgaataatcngtgccgcagatcctggtccataagatgcagctgatcttctgaggatgtgtctccaatgtg

SEQ ID NO: 39337 - DNA, 727 bp, Zea mays
  misc_feature: Ceres CLONE 1429273-F
aaagctggagctccccgcggtggcggccgctctagaactagtggatcccccgggctgcaggaattcgcacgagaccattacctagaacatcctaatcgaaaaaccagagagtcagagtgcggaggtgaacgtgacgtgacgctcctcctctataaaaggagacgcctgtgctgcagtgtgcacagcacagcccgtcgcgcgccgctgcgttgaggttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggctccggcggcggccacagcccgccccaccatagcaagccgcccaagcaccaccatggcaagccgcccaagtgcccgccgtgcacccctccgtacgtgcctccgacgcctcgcccgtcaccgccgtacgtgccaccatatgtcccgccgacgcctcggccatcaccaccaccgtacgtgccaccatacgtccccgtcccgccgacgcctcggccctcaccgccctacgtgccaccatacgtccccgtccccccgacgcctcggccgtcaccgccgtacgttcccccgacgccacggccgccgactccgccctacgtcccaccgacgccgccctacgtcccaccgac

SEQ ID NO: 39338 - DNA, 641 bp, Zea mays
  misc_feature: Ceres CLONE 1429277-F
  misc_feature: Translation starting site: 203
  misc_feature: SWISSPROT Homolog: EC 2.5.1.47 Cysteine synthase
  misc_feature: SWISSPROT Homolog: EC 4.2.1.22 Cystathionine beta-synthase
  misc_feature (430)..(430): n is a, c, t, g, unknown, or other
  misc_feature (449)..(449): n is a, c, t, g, unknown, or other
  misc_feature (455)..(455): n is a, c, t, g, unknown, or other
  misc_feature (456)..(456): n is a, c, t, g, unknown, or other
  misc_feature (592)..(592): n is a, c, t, g, unknown, or other
aagctggagctccccgcggtggcggccgctctagaactagtggatcccccgggctgcaggaattcgcacgagaccattacctagaacatcctaatcgaaaaatctccagcggcttcttccaaagctccaactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccagctcgagtccatggagccctgctccagcgtcaaggataggattggctacagcatgatcacggacgcagaggagaaagggctgattactcaggcgtgagtgttctgattgaccaacntagcgcacacaggcattgnactggnnctttatgctgctaccaaggctacaaacttacactcacaatgcctggctccatgagcatggagaggaggatcatattggaggcttttgtgctgaacttgtcctactgacccactcttgggaatgaaggagctgtcangaaagcggaagaaatacagcaaagaccccaactcgtacattctcaacaa

SEQ ID NO: 39339 - DNA, 772 bp, Zea mays
  misc_feature: Ceres CLONE 1429291-F
  misc_feature: Encodes the peptide sequence at SEQ ID NO. 39340
  misc_feature (437)..(437): n is a, c, t, g, unknown, or other
  misc_feature (491)..(491): n is a, c, t, g, unknown, or other
  misc_feature (515)..(515): n is a, c, t, g, unknown, or other
  misc_feature (685)..(685): n is a, c, t, g, unknown, or other
  misc_feature (759)..(759): n is a, c, t, g, unknown, or other
  misc_feature (772)..(772): n is a, c, t, g, unknown, or other
aaagctggagctccccgcggtggcggccgctctagaactagtggatcccccgggctgcaggaattcgcacgagaccattacctagaacatcctaatcgaaaagacgacgctgacgcggctgaaaatttccacgaacacatagatccgcatcgtcgatccatccgtcctcctcccgacggtacgccagcctgccagagtccgacgcacgcctagggctcctggacacagcagagcccacgccttgactcgctccgttcgagtggagcgcacaggcaccggccggcgaccagagagggagcggatcgagggggctccgcttgaggggaggagatggaccgcaaggatgccggggatcctcggcatggacatctacttcccgcccgccggggggggggcagggaagcacttgggggccctagggtgggggcggggcaagngggaaggacgccctttgggcctgggggcaagggttgcacgggggcgtttgccanccgaggcgggaaggatgtcactcntcaattgaagtttgaccggtccggggcatttctccctgccggaaaaagaataccaggattggatccccaagcccaattggtccccgcttggaaggtgggaagggtgaaacccgtttgtttgccgaaagggagactcggcgcaaaactgggcgtggaggccgcatttgtgnaggagaggggccaaaactcgggcttcgagggggggctaacccccgagcaagggccggttcgggggggggaccgnacgcgcctaccgn

SEQ ID NO: 39340 - protein, 147 aa, Zea mays
  misc_feature: Ceres CLONE 1429291-F
  misc_feature (36)..(36): Xaa is any aa, unknown, or other
  misc_feature (54)..(54): Xaa is any aa, unknown, or other
  misc_feature (62)..(62): Xaa is any aa, unknown, or other
  misc_feature (119)..(119): Xaa is any aa, unknown, or other
MDRKDAGDPRHGHLLPARRGGGREALGGPRVGAGQXGRTPFGPGGKGCTGAFAXRGGKDVTXQLKFDRSGAFLPAGKRIPGLDPQAQLVPAWKVGRVKPVCLPKGRLGAKLGVEAAFVXERGQNSGFEGGLTPEQGPVRGGDRTRLP

SEQ ID NO: 39341 - DNA, 662 bp, Zea mays
  misc_feature: Ceres CLONE 1429292-F
  misc_feature: Encodes the peptide sequence at SEQ ID NO. 39342
  misc_feature (460)..(460): n is a, c, t, g, unknown, or other
  misc_feature (526)..(526): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctcccgtggtgggctgggcgtggccacgccggtgttcctgatnctcagccccgtgctcgtcccccgcgcgctgctcatcgggacggccgtcatggggttcctcacgtcnggcgcgctggggctcgggggcctgtcctcgctcacgtgcctcgccaacacggcgcggcaggcgttccacgcaccccggactacgtggaggaagcccacgcaggatggcggaagccgcgcgcacgcggccacaagaa

SEQ ID NO: 39342 - protein, 152 aa, Zea mays
  misc_feature: Ceres CLONE 1429292-F
  misc_feature (44)..(147): Pfam Name: Oleosin Pfam Description: Oleosin
  misc_feature (85)..(85): Xaa is any aa, unknown, or other
MADRDRSGIYGGAHATYGQQQQQGGGGRPMGEQVKGMLHDKGPTASQALTVVTLFPLGGLLLVLSGLALTASRGGLGVATPVFLXLSPVLVPRALLIGTAVMGFLTSGALGLGGLSSLTCLANTARQAFHAPRTTWRKPTQDGGSRAHAATR

SEQ ID NO: 39343 - DNA, 671 bp, Zea mays
  misc_feature: Ceres CLONE 1429296-F
  misc_feature: Encodes the peptide sequence at SEQ ID NO. 39344
  misc_feature (414)..(414): n is a, c, t, g, unknown, or other
  misc_feature (497)..(497): n is a, c, t, g, unknown, or other
aagctggagctccccgcggtggcggccgctctagaactagtggatcccccgggctgcaggaattcgcacgagaccattacctagaacatcctaatcgaaaaatgctatgcgcttcctccacatacaagaccaccgcagatcaaaacacacatctctctcactcactcactcgcctcactccactggacatccatccatggagctcttcgcagcagcagcatcagccgaggatcagaagccgtgcagcagcaggctgttcagcaggaagaggagcggcggcaaggcgggcatgggcgtgcgcggcgccgacaagggccggtcgtccttctccgggcggtgcgcgcggctcgtcaaggagcagcgcgcgcggttctacatcatgcgccgctgcgtcacgatgctggtgtgctggcncgagtacgcctgacgcctgagccctccgtgtccctgatgcaatgcgcccgacatgatgcggaccccatgcaggacccgaccancagcccaaggggaaaggaggagaagaagggaacccccccccgccccccaaccaagtaaaaaaaccctccaacccccctccccggccttattaggggacccccaaccgaaccttggggaaaaaaaaaaaaaaaaaattttttttaataattccccccccccggcttaaaggcccc

SEQ ID NO: 39344 - protein, 76 aa, Zea mays
  misc_feature: Ceres CLONE 1429296-F
  misc_feature (53)..(71): Pfam Name: DVL Pfam Description: DVL family
  misc_feature (73)..(73): Xaa is any aa, unknown, or other
MELFAAAASAEDQKPCSSRLFSRKRSGGKAGMGVRGADKGRSSFSGRCARLVKEQRARFYIMRRCVTMLVCWXEYA

SEQ ID NO: 39345 - DNA, 667 bp, Zea mays
  misc_feature: Ceres CLONE 1429297-F
  misc_feature: Translation starting site: 183
  misc_feature (221)..(221): n is a, c, t, g, unknown, or other
  misc_feature (530)..(530): n is a, c, t, g, unknown, or other
ctggagctccccgcggtggcggccgctctagaactagtggatcccccgggctgcaggaattcgcacgagaccattacctagaacatcctaatcgaaaaatccgcagtccatacagtgacccccacgaggtcaagaacctgtacgaggagaggaaagaacctggaagagaggagcttgaggagatggcgagcgccgagggcgagaggtgggtgggactggcnacggacttctcgcaggggagccgagaggcgctgcagtgggcggcgaccaacctgctccgcgccggcgaccacctgctgctgctgcacgtcatcaaggagccccgactacgagcagagcgaggccatcctctggggatcccacggctccccgttgattccgcgtctcgagtctctgaccctattatcgcgaagaaatatggagcaaaacccgacatgaaaaccttggactccctgacactacagctacccagaaggaaattatggtggttgtgaaagtcctgtggggagatccgcgtgagaagctctgtncagttatccatgacacccccgtgagctgcttggttataggaagcaggggcctgggcaactcaggagggtgctcttaggaagcgtcagcgattacgtcgtgaaccacgcaacctgccctgtcaccgttgttcagtcat

SEQ ID NO: 39346 - DNA, 661 bp, Zea mays
  misc_feature: Ceres CLONE 1429298-F
  misc_feature: Encodes the peptide sequence at SEQ ID NO. 39347
  misc_feature (424)..(424): n is a, c, t, g, unknown, or other
  misc_feature (452)..(452): n is a, c, t, g, unknown, or other
  misc_feature (514)..(514): n is a, c, t, g, unknown, or other
  misc_feature (556)..(556): n is a, c, t, g, unknown, or other
  misc_feature (557)..(557): n is a, c, t, g, unknown, or other
  misc_feature (563)..(563): n is a, c, t, g, unknown, or other
  misc_feature (583)..(583): n is a, c, t, g, unknown, or other
aaagctggagctccccgcggtggcggccgctctagaactagtggatcccccgggctgcaggaattcgcacgagaccattacctagaacatcctaatcgaaaaacatccatcctcgctagctcgctcgctctccttgcaactccagtgctgctcactgccactgccagcagatcgagctgctccgtctcacaaaccctcttgctttgctgctgcacctgcaagtctgcaaccgcgcacacagagatgtcgacgacggtgagccgtgcgtccctcgaccagaagctcgccctcgccaagcgttgctcccgagaggcgaccctcgccggagccaaggcggcagcggtggcgactatcgcctccgcgatccccaccctggccagcgtgcggatgctgccatgggccaaggccaacatcacccccaccnggccagcgctcatcgtctccacggtggnctgggatggcctacttcatcgccgccgacaagaagatcctgtcgctgggcgagcgccactcngtcgagcaagcccctgagcacctcaagaacacctccttcgannggcacngccgtccccacccagccttnctcagggcgtgagacgagacctccgtccagagctagctacctacctctttttccagttggcaatggcagcacaaatgc

SEQ ID NO: 39347 - protein, 95 aa, Zea mays
  misc_feature: Ceres CLONE 1429298-F
  misc_feature (12)..(82): Pfam Name: ENOD93 Pfam Description: Early nodulin 93 ENOD93 protein
  misc_feature (61)..(61): Xaa is any aa, unknown, or other
  misc_feature (70)..(70): Xaa is any aa, unknown, or other
  misc_feature (91)..(91): Xaa is any aa, unknown, or other
MSTTVSRASLDQKLALAKRCSREATLAGAKAAAVATIASAIPTLASVRMLPWAKANITPTXPALIVSTVXWDGLLHRRRQEDPVAGRAPLXRASP

SEQ ID NO: 39348 - DNA, 667 bp, Zea mays
  misc_feature: Ceres CLONE 1429302-F
  misc_feature (352)..(352): n is a, c, t, g, unknown, or other
  misc_feature (395)..(395): n is a, c, t, g, unknown, or other
  misc_feature (410)..(410): n is a, c, t, g, unknown, or other
  misc_feature (426)..(426): n is a, c, t, g, unknown, or other
  misc_feature (480)..(480): n is a, c, t, g, unknown, or other
aagctggagctccccgcggtggcggccgctctagaactagtggatcccccgggctgcaggaattcgcacgagaccattacctagaacatcctaatcgaaaactcgttgtcttggcggctgcggcggagcacggaggcgaaggaggagcagcagcagcaggcggcgccgaggagcggcatcccactcagtgcttgcaaccatggctaggggattgaagagcacttgaagagctcaatgcgcccaagcattggatgctcgacaagcttggcggagcttttgctccccagcatcttctggacctcacaagtccagggagtgccttcctctgatcctcatcatcaggaacaggctncagtatgctctgaactaccgtgaggtcatttctatcctgatgncacgccatgtacttngtgatggcaaggtcangactgacaagactaccctgctggggtcatggatgtcatttccatccctaagacnatggagaactacaggctgctttatgacacaaggggcgcttccgtcttcacccaatcagggatgaggatgcccaggtcaggctctgcaaggggaggtcccttcagtttggccaggagggcatcccctacctgaacacctacgacgggcgtaccatccgctaccccgacccggttatgagggccaacaa

SEQ ID NO: 39349 - DNA, 607 bp, Zea mays
  misc_feature: Ceres CLONE 1429303-F
  misc_feature: Encodes the peptide sequence at SEQ ID NO. 39350
  misc_feature (233)..(233): n is a, c, t, g, unknown, or other
aagctggagctccccgcggtggcggccgctctagaactagtggatcccccgggctgcaggaattcgcacgagaccattacctagaacatcctaatcgaaaacccttggcttcgttccatccggcttctcggcggcggcggagaggagggggatggcgcaccggctgctgcgggacgcgcaggcggacgggtgggagcggtcggacttccccatcatctgcgagtcatgcctcnggcgacaacccccctaccgttccgggatggtttaaggagcgcttaaaatttttggcccaaaaaaagggccaaaattttggggccccgccctttttctggattcccgggggggccccggggggaaatcccggggcccaaaaaacttggaatctccccaaaaatgtgtcacaacaaaaaaaatttttcccccggccccccccccgggaattttaaaaaaaaggggcccccccttttggggccccaaaaaaaaaaaacccccctcttttttttttttcccgggggggggggccccccccggggggggggggggccccccccccccccatttttttttttttcacacaaaaaaaatttcttgggggggggggcgcccc

SEQ ID NO: 39350 - protein, 38 aa, Zea mays
  misc_feature: Ceres CLONE 1429303-F
  misc_feature (28)..(28): Xaa is any aa, unknown, or other
MAHRLLRDAQADGWERSDFPIICESCLXRQPPYRSGMV

SEQ ID NO: 39351 - DNA, 706 bp, Zea mays
  misc_feature: Ceres CLONE 1429306-F
  misc_feature: Encodes the peptide sequence at SEQ ID NO. 39352
  misc_feature (414)..(414): n is a, c, t, g, unknown, or other
  misc_feature (636)..(636): n is a, c, t, g, unknown, or other
  misc_feature (637)..(637): n is a, c, t, g, unknown, or other
  misc_feature (639)..(639): n is a, c, t, g, unknown, or other
  misc_feature (640)..(640): n is a, c, t, g, unknown, or other
  misc_feature (643)..(643): n is a, c, t, g, unknown, or other
  misc_feature (644)..(644): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaagattatataaaattaatgatgcacgcggcagcatgtgcagcgtacatacaaaaccctggatcagccagcgttccattccaacgacagcacagcagagcaagagcgcaccagcacgacacagccaagctccactccaccgacacgctgcgctcgagcccgcccgcgagatccatggcgcggctgctaccgacggccgcggcagcggccatcgtggccgccgtcctggtggcgggcctgccgggcgccggggcggcgtctgcctcgccggctgcggacgacgcgcccgcttacaggacccacaccgtggcggcngcgaacggtgggttcttcgacgccaacacaacgcctcgtctgggaactactccgactgggccgcccgcgagaccttctaccttcggtgactacctcattttcaaagacaaaccacaccttcctcgggtggtgcaaaaccacaacccccacaaaataagggggtcttggaaacccccgggaacaaactgggggaaaaccaacttccctttttccggggggccnncnnccnngngggggccccccccccttcaaagaaaaacaaccccccttcgggggggggccccccaccccg

SEQ ID NO: 39352 - protein, 144 aa, Zea mays
  misc_feature: Ceres CLONE 1429306-F
  misc_feature (122)..(122): Xaa is any aa, unknown, or other
  misc_feature (123)..(123): Xaa is any aa, unknown, or other
  misc_feature (124)..(124): Xaa is any aa, unknown, or other
  misc_feature (125)..(125): Xaa is any aa, unknown, or other
MARLLPTAAAAAIVAAVLVAGLPGAGAASASPAADDAPAYRTHTVAAANGGFFDANTTPRLGTTPTGPPARPSTFGDYLIFKDKPHLPRVVQNHNPHKIRGSWKPPGTNWGKTNFPFSGGPXXXXGPPPLQRKTTPLRGGAPHP

SEQ ID NO: 39353 - DNA, 665 bp, Zea mays
  misc_feature: Ceres CLONE 1429307-F
  misc_feature: Translation starting site: 233
  misc_feature (295)..(295): n is a, c, t, g, unknown, or other
  misc_feature (298)..(298): n is a, c, t, g, unknown, or other
  misc_feature (410)..(410): n is a, c, t, g, unknown, or other
  misc_feature (419)..(419): n is a, c, t, g, unknown, or other
  misc_feature (450)..(450): n is a, c, t, g, unknown, or other
aaagctggagctccccgcggtggcggccgctctagaactagtggatcccccgggctgcaggaattcgcacgagaccattacctagaacatcctaatcgaaaaatccccaatatatccccactcttcgcctcctttctggagcagctagggttccgtcctcgatccgatccgccgagtgcacaccacctttccccactccgatcgaatcgatggccgccgagggcgagaagagatgataaccctcaaaagctccgatggcgaggagttcgaggtggaagaagcggtggcaatggantcncagaccatcccgcacatgatcgaggatgactgcgccgacaacggtatccctcttcctaacgtcaactccaagatcctagtggaggtaatcgagtactgcaacaggcacgtanatgccgccngccgccgccgcccgccgcttgaaggcctttnccgacgacgtgggtgccgcctccgccaacagcaccgccgcctccggtgaagacctcaagaactgggatgcggacttcgtcaaggtcgaccaggcccgcctttccacctcatcttggctgcaactatctaaacatcagggtctgctcgactgacctgtcagactggtgctaacatgaccagggcaaaacaccaaagagatccgcagaccttcaaaa

SEQ ID NO: 39354 - DNA, 620 bp, Zea mays
  misc_feature: Ceres CLONE 1429311-F
  misc_feature: Encodes the peptide sequence at SEQ ID NO. 39355
tcccccgggctgcaggaattcgcacgagaccattacctagaacatcctaatcgaaaaggtctaggccatggccatgtccgcttcctcctcctcgcgcgccctcctccgccggatcggcggagcgctcctccgccgctccttctcctcctcatccgccgccgccgccgcagggtaccacgtcgcgggcgggcccagctacatgcgcggcgccatcatctgggagcccggccgctcgctcacgctcgaggagttccgcatgccgcgccccaagggcggcaagctcctcatcaagaccaaagcctgcggcggctaccactccgatctccatgtccacaaaggtgagctccctttctcccacaccctgtgtacttggaccatgagatacactgtagaggtggttaacaatggtacgcacgctcgtgcggacatccatcaacgggttcccagtcggaaatctcaacctcagggactttcataaagacgtgtgggaactgcttcaactgcgttaagcggcaaaaaatatctggggccactctgttcttcggcgaaaaaccctgccaacggggacactgctatgaaaaaaaagataacggctgtttcataagaagaaaaggggacaa

SEQ ID NO: 39355 - protein, 136 aa, Zea mays
  misc_feature: Ceres CLONE 1429311-F
  misc_feature: SWISSPROT Homolog: EC 1.1.1.1 Alcohol dehydrogenase
MAMSASSSSRALLRRIGGALLRRSFSSSSAAAAAGYHVAGGPSYMRGAIIWEPGRSLTLEEFRMPRPKGGKLLIKTKACGGYHSDLHVHKGELPFSHTLCTWTMRYTVEVVNNGTHARADIHQRVPSRKSQPQGLS

SEQ ID NO: 39356 - DNA, 730 bp, Zea mays
  misc_feature: Ceres CLONE 1429314-F
  misc_feature (391)..(391): n is a, c, t, g, unknown, or other
  misc_feature (395)..(395): n is a, c, t, g, unknown, or other
  misc_feature (404)..(404): n is a, c, t, g, unknown, or other
  misc_feature (405)..(405): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (417)..(417): n is a, c, t, g, unknown, or other
  misc_feature (420)..(420): n is a, c, t, g, unknown, or other
  misc_feature (547)..(547): n is a, c, t, g, unknown, or other
  misc_feature (548)..(548): n is a, c, t, g, unknown, or other
  misc_feature (560)..(560): n is a, c, t, g, unknown, or other
  misc_feature (730)..(730): n is a, c, t, g, unknown, or other
ggagctccccgcggtggcggccgctctagaactagtggatcccccgggctgcaggaattcgcacgagaccattacctagaacatcctaatcgaaaaaaaaaataaaaagaaaaaaaataaaaaaaagagaggaaaaggggacaaaccaccaacaacaaccagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcngcanagctccttnngnnnnnnntggntgnggttttgttctcggcgtcggctgggggaaggcgagtagccccgggaaggacgagtgaataatcatgagctcgatctgccctttcgcgggagccccccttggtggtggtgtatgcccctggtaagccnnataaaaccaccnctggggtgtgcccttcaaaagcttacaggacctccgctggcttgtccccccggcctggcgtgttcgagggaggatgttcctgtggttgttgaaccggggttaatgtataggggtcctttgcgttttgggtgcgctcttactctctttcccgttcggaaccccttttggcn

SEQ ID NO: 39357 - DNA, 895 bp, Zea mays
  misc_feature: Ceres CLONE 1429315-F
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttctcccttctcccgtgtattgtgtggttattagtgggttttnnntaaaactgtggctccccgcggtggcggccgctctttactagtggatcccccgggctgcaggatttcgcacgagaccattacctagaacatcctaatcgaaaaagattgggtccttggttacagcacccgccgcatccgtcacattcacagcgcgtgcgtgctctctctccccctccccctctccgtgcgactactgggtgggctaccgccgccctacgcaaggtgccgagaacttcgctgatatctgcgccagagaagagcgcccaacagatcaggccgcttagaaggcgctgatggtcgccgggatgacgattggccgggggcgcggcgattgaacccagttctgcatcaagggggtaactgcccacgtgtacagcttcgcgacgagtgggggcgggcgggtgcttgtcaagcgtgcgatgcggcgcccatggtgtcgtttttttatgatccctgatcctggtgggacgcattctccgtgggtttattggccgtacgacccccgttgatgtgaatcgccacacccttattttcaccccgccctccccgggtctttgcggtcccccccccccccccagcccctggctctgtttctcccccgcgccccccccgcccccgcgtttttggcctgcttattctccccccgatctcccaggttctctccgaccgtgctggtggcgtgctttggtgagtcggggatttctagtattcccttccgcccaacccttgtgctagcccccggctggttttgtgttgtttttcctttacgcgccgctgccgcgcctcggcgcttccacctttttggagtccactctccgcctccgaccgtccttagcaggacccactctcc

SEQ ID NO: 39358 - DNA, 673 bp, Zea mays
  misc_feature: Ceres CLONE 1429316-F
  misc_feature: Encodes the peptide sequence at SEQ ID NO. 39359
aagctggagctccccgcggtggcggccgctctagaactagtggatcccccgggctgcaggaattcgcacgagaccattacctagaacatcctaatcgaaaaaccaaaggtaccttgcaatcacaacgaacagaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgccgcgcctgcgcctgcgtctgcgtctggctaaaagagatcattcgtcgcccgtcattaggggccagcacgtatggctgtaaatggtggtccttatccagttctggctttgtccgcttgggggccaattgggaacaagtagtattgttggtttctttcgcaacccg

SEQ ID NO: 39359 - protein, 122 aa, Zea mays
  misc_feature: Ceres CLONE 1429316-F
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVDVDEVKEVTAAYEVEAMPTFHFVKNGKTVATIVGARKDELLAQIEKHAAPAPASASG

SEQ ID NO: 39360 - DNA, 667 bp, Zea mays
  misc_feature: Ceres CLONE 1429318-F
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaggggcgtggcaggaatcaggagagagatagcagggggggctagctagctgacctcgtgccaccaaggatgggccggaattggcagggacatggtggccccccctcctgggggcgtcaacctcatcatgtacatcatcctcatcggcttcccgaaggtggaacctgaaccacttcatcaaggggaagacccactaccccgggcgtggccggaaacggcccaaccttttacttcctggggttccccatccctggccgggttggtgggccccccccccaagttgggggggtgaaccacggggccccctgggcccacaaaaacttggccacaaagccccgtttgtccctatatcctggggcacaaggggcttccctttggggtgggcaaaaaan

SEQ ID NO: 39361 - DNA, 912 bp, Zea mays
  misc_feature: Ceres CLONE 1429320-F
  misc_feature: Encodes the peptide sequence at SEQ ID NO. 39362
  misc_feature (1)..(1): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (84)..(84): n is a, c, t, g, unknown, or other
ngggcccatttaaaatttttttttnnnnnncnaaaaaaataaaaaaggtcaagctggagctcaccgcggtggcggccgctctanaactagtggatcccccgggctgcaggaattcgcacgagaccattacctagaacatcctaatcgaaaagcacaagtcacaacagaacaacctacccccacaagcagaaggatccgggcggccaccgagagtcactggaagaagctcgtccggcgccccgcgacgagacgacggcctcctcctccgctccgctgaagaacgacctccccgctgacagcgttggcgggccttgtagcgaggagggggtgcggaggcgccccaactgttcgcggagatgagcttttgcagcagcaggttccctcgcatccaggggcaaaaaagggcctttcgagataccggaaaaacctgagggtggttaaagccccaaggggccaccccccaaagccccaccatttgttctgggggtcccacgacactttgggcggaaccaagtgggaagcccaggctggggtccccccaacctacaccgggaaaaaaacagcctcacccccccctctccctaaaggaatatagcaaactggcgactttctgcgccgccataggtggtaacccactgtccaacgaaccccccgctgctcaaagcgcgtttctttggggagaggggcttccccaccaccccacaataaaaaaatgagggtataggggaagacttcgccgccaactccctctcccgtgcggggtgatcgcccttccccccaaaggataccttgtggatgtgatgatatctcagcttggctcttcgtctctacggacccactggtgtcggcgaaacaattctcctcgtcgtccagcccagtgaaccctccgtgtgtacacatcagttaactcgg

SEQ ID NO: 39362 - protein, 43 aa, Zea mays
  misc_feature: Ceres CLONE 1429320-F
  misc_feature (8)..(8): Xaa is any aa, unknown, or other
  misc_feature (9)..(9): Xaa is any aa, unknown, or other
  misc_feature (10)..(10): Xaa is any aa, unknown, or other
  misc_feature (28)..(28): Xaa is any aa, unknown, or other
GPFKIFFXXXKKIKKVKLELTAVAAALXLVDPPGCRNSHETIT

SEQ ID NO: 39363 - DNA, 596 bp, Zea mays
  misc_feature: Ceres CLONE 1429321-F
  misc_feature (287)..(287): n is a, c, t, g, unknown, or other
  misc_feature (347)..(347): n is a, c, t, g, unknown, or other
  misc_feature (353)..(353): n is a, c, t, g, unknown, or other
aagctggagctccccgcggtggcggccgctctagaactagtggatcccccgggctgcaggaattcgcacgagaccattacctagaacatcctaatcgaaaatcccacgagcgccccccctgccctgcccatttcgctctcctccctaggcaactaaacgccgcgctcccgcagacggtaccagccgccgcgatggggtcctcgtcctcgccaccgcaccaccgccgctggcattgccatgatgggcggggccgggacctcacatcttcatcacgcggcatcccccgntaggacgccccggggcgctggggccacgccgcgcctcagtcccgcgctggattttcccancattcngaaaaggagcccgggggctcctttctcctctcgggaccaccaagccgggcgggggctggggtgggtccccccgccccccccttttttttaattccccttccccgggggaggcccccccccaaaaaaaaagggcccgggggggaaaaataaatatgggttttctttcttttggaaccccccccgccccccaaaaaccccccgaccctcaaaaaaattttttcccccgtgtgggggggaaacact

SEQ ID NO: 39364 - DNA, 664 bp, Zea mays
  misc_feature: Ceres CLONE 1429323-F
  misc_feature: Encodes the peptide sequence at SEQ ID NO. 39365
ggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccgttgctgggtgccgggccgccatcccgcttggcgctcatggggggccgggtttgtccccccggggggccctggggtcccctgcccttgcccgggttccccggggaaggaaaaataccctgaaggggaaaacccccccccgggggcccaaacatgttggacccccccaaagggaggggttgggggtccaaaaggcccccccaattcaaggagtgggggaaaaaacccccctttta

SEQ ID NO: 39365 - protein, 119 aa, Zea mays
  misc_feature: Ceres CLONE 1429323-F
  misc_feature (36)..(120): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPLLGAGPPSRLALMGGRVCPPGGPWGPLPLPGFPGEGKIP

SEQ ID NO: 39366 - DNA, 681 bp, Zea mays
  misc_feature: Ceres CLONE 1429324-F
  misc_feature: Pfam Name: Spermine_synth Pfam Description: Spermine/spermidine synthase
  misc_feature: SWISSPROT Homolog: EC 2.5.1.16 Spermidine synthase
  misc_feature (260)..(260): n is a, c, t, g, unknown, or other
  misc_feature (411)..(411): n is a, c, t, g, unknown, or other
aaagctggagctccccgcggtggcggccgctctagaactagtggatcccccgggctgcaggaattcgcacgagaccattacctagaacatcctaatcgaaaatcccacctcccaactccagaagtcctccctagacgccgccagccgcgcgcacacccacggagagctcctcgggctttctttctccgttcctccctcgcgcgctcagggtttcacgatggaggcccgagcggcggccaagaggggcgcggagggcgggnaagaccccacgcgccgggtggcgggggccaaggcggtggtccccggtgctggcaagcagcgggaatctcccccgtcatcccaggatggttctcccagatcagccccatgtggccccggtgggggggagtgcgttgaagtaaaaaaagttcntctcccccccaagtcaaactaccaaaatgggatggttttttcacccctccacggaggggaagggtcttggccctccacggatttttccggggaacagaaagggatgagatcccctaccaagaagatatatacccccctgcccctttgccccaacaaacaccccaaaaaaggttttgtttatgggggggggggatatgtggttgtttttcccataaatttccacccaacatttcgtgggggaacaaatttggacttcgtcaaacaataaaa

SEQ ID NO: 39367 - DNA, 838 bp, Zea mays
  misc_feature: Ceres CLONE 1429328-F
ggggggggggggggaggggggggcaggccggggggggggggaggggctcggcgggactttattcacaactggagctccccgcggtggcggccgctctagaactagtggatcccccgggctgcaggaattcgcacgagaccattacctagaacatcctaatcgaaaagacgctcgacgcctctcctcctctcctcccccacccgtccatcgcccctccctccggtctgcgctcccaacaggctcacccctgcgcccccgccgattcgcatcggcctttgttggaaggaacgatggagcagaccttcatcgtgatccagcccgacgggcgtccagcggggacctggataagagacatcgtcagagggtttggaggaaaaaagggggtgctacctccagagcggatggaaggctgtcatggacggtggaaaaggatccccttcccagcaggcaggcaccggcgccggggaacatttgcccgagcggagggcgttatccattccccccagggtcttggaggggaagacaacaccccacgttctcccggggccgcccacgggggggggggggaatgggcgctatggggaggggggagaaagaggacaccgcctcgttcgtagaacctctggggcccccgaaggcagaccgcggggggagcccccacccgcggggctctgtggagaagggcggggcccgcgcggggttaaacatatggggggggggaatggacgcccggcgcgagacgaaggggcgcagagggagagcagagggccgggacaaacgaaacaggggggagtggtagaggcttaaacaaaaggagaagtgttgctggcggggcggc

SEQ ID NO: 39368 - DNA, 728 bp, Zea mays
  misc_feature: Ceres CLONE 1429334-F
  misc_feature: Encodes the peptide sequence at SEQ ID NO. 39369
aagctggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggtgatggaactacaactgcctctgttctcgctagggagatcatcaaattgggcatgttgagcattacttcaggggcaaatccagtgtccgttaagaagggcattgataagactgttcagaaattggtggaggaacttgagaagaaacaaggccggtcaagggtagtggggatatt

SEQ ID NO: 39369 - protein, 188 aa, Zea mays
  misc_feature: Ceres CLONE 1429334-F
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMLSITSGANPVSVKKGIDKTVQKLVEELEKKQGRSRVVGI

SEQ ID NO: 39370 - DNA, 723 bp, Zea mays
  misc_feature: Ceres CLONE 1429343-F
  misc_feature: Encodes the peptide sequence at SEQ ID NO. 39371
  misc_feature (706)..(706): n is a, c, t, g, unknown, or other
aagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgcgccgctctcggtcatgaaattggtgatccagacnaagagcgtgaaatacat

SEQ ID NO: 39371 - protein, 164 aa, Zea mays
  misc_feature: Ceres CLONE 1429343-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFGTGMYAAPLSVMKLVIQTKSVKY

SEQ ID NO: 39372 - DNA, 716 bp, Zea mays
  misc_feature: Ceres CLONE 1429350-F
ctccccgcggtggcggccgctctataactagtggatcccccgggctgcaggaattcgcacgagaccattacctagaacatcctaatcgaaaactccgccctccgcctcctcagtgctccggcgcctagcgacctgctcctgcccccgccgccgccgtgcacgcacagccggagcaggagcagcgctgcccgcctttaccgttgcccatggagaactctgccgccgccgccgccgaacggccgcgcctcacccgcgcagccgccaagcgctcagccgtcgtcacggctgtggccgtcgccgccaagcgcaagcgcgtcgcgctcagccagctgcccacgctccccaacgccgtgctcggcgcgcacgacgacgacgacgacaatcccgtgttatcctcctgcgcctggtcatgctcaatcccaagccgaagggcaatgcagcgcccgcgcctgccgcgcccgccgcctcggatgaagcagatgacgacgttcagctgtctaaggagctcaactcatagctcaaagctctcaccgtcctcacgggacaccagcatatgggcacggatttggacatggtcatggctatgggctatggttatggtcatgggtaagttcaagcaccgggaagttcaagcatcacggaggcaagtttaaacatgggaggcatgggatgtttggaggaggtaagttcaagaagtggaagtgatctaaaaaact

SEQ ID NO: 39373 - DNA, 691 bp, Zea mays
  misc_feature: Ceres CLONE 1429355-F
  misc_feature: Encodes the peptide sequence at SEQ ID NO. 39374
  misc_feature (586)..(586): n is a, c, t, g, unknown, or other
  misc_feature (601)..(601): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
agagctggagctccccgcggtggcggccgctctagaactagtggatcccccgggctgcaggaattcgcacgagaccattacctagaacatcctaatcgaaaaatcggccatcgccatctccatttccagcatagaagacgcgatacagctcaaggacagcgctccgcacccgcacgcaagccagaccggaccgaatcgaagcagcagcagcgtacagaagatcacaccctactgccgcgctgcactgcacaatgggcatctgcgtgtcgtgcgacgcggcggacgagggcgccgcgacggcggcgcgggtggtgctccccagcggagagctccgggagtacgcgccaccggccaccgccgcggaggcgctgcaagcggcgggcgagggctcgtcgtggctcctctgcgacgccgacgggatggcgttcgagggccccgttcgcagtcgcggcggtcgcgcccggggtcccgagcccccggggggggggaaaatttatttttggggcccccccccccaaaaaaaaaaaaggcccccccccctttttcccggagaaaaaaaagagcccccccccccccctccgccggngggcgggggttggtncttnnnnnnnnnnnnggnnnnggggggggggggggggggcgcccccaaaaaaatttttcctcttcccccccccccccggggggggggggg

SEQ ID NO: 39374 - protein, 146 aa, Zea mays
  misc_feature: Ceres CLONE 1429355-F
  misc_feature (112)..(112): Xaa is any aa, unknown, or other
  misc_feature (117)..(117): Xaa is any aa, unknown, or other
  misc_feature (118)..(118): Xaa is any aa, unknown, or other
  misc_feature (119)..(119): Xaa is any aa, unknown, or other
  misc_feature (120)..(120): Xaa is any aa, unknown, or other
  misc_feature (121)..(121): Xaa is any aa, unknown, or other
  misc_feature (122)..(122): Xaa is any aa, unknown, or other
  misc_feature (123)..(123): Xaa is any aa, unknown, or other
  misc_feature (124)..(124): Xaa is any aa, unknown, or other
MGICVSCDAADEGAATAARVVLPSGELREYAPPATAAEALQAAGEGSSWLLCDADGMAFEGPVRSRGGRARGPEPPGGGKIYFWGPPPQKKKRPPPLFPGEKKEPPPPPPPXGGGWXXXXXXXXGGGGGGAPKKIFPLPPPPRGGG

SEQ ID NO: 39375 - DNA, 716 bp, Zea mays
  misc_feature: Ceres CLONE 1429364-F
  misc_feature: Encodes the peptide sequence at SEQ ID NO. 39376
  misc_feature (205)..(205): n is a, c, t, g, unknown, or other
  misc_feature (326)..(326): n is a, c, t, g, unknown, or other
  misc_feature (375)..(375): n is a, c, t, g, unknown, or other
aaagctggagctccccgcggtggcggccgctctagaactagtggatcccccgggctgcaggaattctcacgagaccattacctagaacatcctaatcgaaaactccccaactcgccgtctgccttctgcgcctccatttttgcctctgtgtctctgtgaaggttcaatctcacctccaaccatggggtaaagagaagtcccacantcaacattgttgttatttggccatgtcgactctggcaagtcgaccaccacaggacaccttatctacaagcttggaggcattgacaagcgtgtgatcgagaggtttgagaaggaggctgctngaatgaataagcggtccttcaagtacgcgtgggtgctcgacaagctcanggctgagcgtgagagaggtatcaccattgatattgctctgtgggagtttgagaccaccaagtactactgcacggtcattgatgcccctggacaccgtgacttcatcaagaacatgatcactggtacctcccgggctgaactgggctggtccttatcattgactcccccactggtgggttttgaggctggtttcccccagggtgggcccaacccctgaaaaatgctcccccttgggtgttcccccctttgggagtgaaaccaaaatttttttttctcctctccacccaaggttggggtggggcaccccccccccccaaaaatacccccagggggggcgcttt

SEQ ID NO: 39376 - protein, 87 aa, Zea mays
  misc_feature: Ceres CLONE 1429364-F
  misc_feature: SWISSPROT Homolog: EC 2.7.7.4 Sulfate adenylyltransferase
  misc_feature (16)..(16): Xaa is any aa, unknown, or other
MNKRSFKYAWVLDKLXAERERGITIDIALWEFETTKYYCTVIDAPGHRDFIKNMITGTSRAELGWSLSLTPPLVGFEAGFPQGGPNP

SEQ ID NO: 39377 - DNA, 734 bp, Zea mays
  misc_feature: Ceres CLONE 1429365-F
  misc_feature: Encodes the peptide sequence at SEQ ID NO. 39378
  misc_feature (619)..(619): n is a, c, t, g, unknown, or other
  misc_feature (631)..(631): n is a, c, t, g, unknown, or other
aaaagctggagctccccgcggtggcggccgctctagaactagtggatcccccgggctgcaggaattcgcacgagaccattacctagaacatcctaatcgaaaatcccacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggcgagcaggcgggaatctccgccgtcatcccaggatggttctccgagatcagccccatgtggcccggtgaggcgcactccttgaaggtggagaaggttctgttccagggcaagtcagactaccaaaatgtgatggtttttcagtcctccacgtacgggaaggtgcttgtcctcgacggagttattcaggtgacagagagggatgagtgcgcgtaccaagagatgattactcacctgcccctttgctccatcaaagaccccaagaaggtgttggttatgagggggggaaatgtggggtgttttttttngggggggtttcnggggttttctttgggggagcggaatgacttctggtgaattgataaaaagggtggtaaatgtcttcaaagcaaatttttcccctcatctaggctgttggattta

SEQ ID NO: 39378 - protein, 149 aa, Zea mays
  misc_feature: Ceres CLONE 1429365-F
  misc_feature (43)..(150): Pfam Name: Spermine_synth Pfam Description: Spermine/spermidine synthase
  misc_feature: SWISSPROT Homolog: EC 2.5.1.16 Spermidine synthase
  misc_feature (134)..(134): Xaa is any aa, unknown, or other
  misc_feature (138)..(138): Xaa is any aa, unknown, or other
MEAEAAAKRAREGGEDATAPVAGAEAVVAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVMRGGNVGCFFXGGFXGFSLGERNDFW

SEQ ID NO: 39379 - DNA, 694 bp, Zea mays
  misc_feature: Ceres CLONE 1429371-F
  misc_feature (278)..(278): n is a, c, t, g, unknown, or other
ctccccgcggtggcggccgctctagaactagtggatcccccgggctgcaggaattcgcacgagaccattacctagaacatcctaatcgaaaaagcgtgtctcgtgctccccccaggctcctcttcctcgctttccctccaccccgggcgcaaaccctaactttaccgtcgctcgccccgcggcgtctgccaatggcgcgccccgtgtgagtgtgcgcgagagaggggtagaccttgaggccgctacccggggaggagagcgagagatgtataaacaanggggggagcgggggtgaggtctaggctggaccgcgagcagatcaacgacgcgctggataagcatgctcgagaggcgggcgcgtcgccatcgacagcgagggggtcggcggtgggcgggcgcgaccaccaccgcctcgtcgtgccgtcctccgtgtcgtccatccccaagggccgctgctccgaaggggagtctgattctgatagtgaagcatcggatgttagcggctctgatggagaagacacctcatggatttcatggtattgcaacttaagagggaatgagttcttctgtgaagtcgacgatgattatattcaagacgacttcaacctttgtggtctcagcagccaagttccttattatgattatgctctcgatctcattttagatatcgagtcatctcatggtgatatgttcc

SEQ ID NO: 39380 - DNA, 701 bp, Zea mays
  misc_feature: Ceres CLONE 1429376-F
  misc_feature: Encodes the peptide sequence at SEQ ID NO. 39381
ctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtggtcgccttggccgcgctggtgctcaccctggcgcacacgcacgagcgcaggtccatgctcgtcggcatcgtctccgtcttcttcggcaccggcatgtacgctgcgccgctctcggtcatgaaattggtgatccagacaaagg

SEQ ID NO: 39381 - protein, 160 aa, Zea mays
  misc_feature: Ceres CLONE 1429376-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFGTGMYAAPLSVMKLVIQTK

SEQ ID NO: 39382 - DNA, 636 bp, Zea mays
  misc_feature: Ceres CLONE 1429378-F
  misc_feature (25)..(25): n is a, c, t, g, unknown, or other
  misc_feature (61)..(61): n is a, c, t, g, unknown, or other
  misc_feature (62)..(62): n is a, c, t, g, unknown, or other
  misc_feature (303)..(303): n is a, c, t, g, unknown, or other
  misc_feature (320)..(320): n is a, c, t, g, unknown, or other
  misc_feature (423)..(423): n is a, c, t, g, unknown, or other
gggggggggggtgggggtggggctnaaaaaaaaaccgcgaggaaggcacgaggtggggccnnttttaaactggggctccccgcggtggcggccgctctataactagtggatcccccgggctgcaggaattcgcacgagaccattacctagaacatcctaatcgaaaatctatcgcactcgtagtcgtagctcaagcatcagcgggcaggagctctgggcagcgtgcgcacgtggggtacctagctcgctctggtagcctaccagggcggatcacccccggggggggcaacgggaagggggggncggggggctttacgggnaaaacctccccaggccgggggggggggatttccccgggggaaggggccaaccccccccccaaaaaaaggggggggggcccccctttgttaaaaaagggggggntttttcttaaagagagggcgccccaaaaggggggccccggaaattttttttggggggggggggaaaaaaaaggggggggggggggctcccccccggggggtatataaatatttggggggggggggggggcccccgcctttattttcccccccccccccccccgccggggggggggcgggggcccccccccctccccgcggggggggggggggg

SEQ ID NO: 39383 - DNA, 708 bp, Zea mays
  misc_feature: Ceres CLONE 1429379-F
  misc_feature: Encodes the peptide sequence at SEQ ID NO. 39384
  misc_feature (629)..(629): n is a, c, t, g, unknown, or other
  misc_feature (640)..(640): n is a, c, t, g, unknown, or other
tccccgcggtggcggccgctctagatctcgtggatcccccgggctgcaggaattctcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtnctcaacgctgntggtggaagaacgggctctgggcttggttctctcctcctggagcgcctgtctgttgactatggcaaga

SEQ ID NO: 39384 - protein, 163 aa, Zea mays
  misc_feature: Ceres CLONE 1429379-F
  misc_feature (49)..(162): Pfam Name: Tubulin Pfam Description: Tubulin/FtsZ family, GTPase domain
  misc_feature (141)..(141): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVLNAXGGRTGSGLGSLLLERLSVDYGK

SEQ ID NO: 39385 - DNA, 724 bp, Zea mays
  misc_feature: Ceres CLONE 1429380-F
  misc_feature: Encodes the peptide sequence at SEQ ID NO. 39386
  misc_feature (479)..(479): n is a, c, t, g, unknown, or other
  misc_feature (495)..(495): n is a, c, t, g, unknown, or other
  misc_feature (506)..(506): n is a, c, t, g, unknown, or other
  misc_feature (556)..(556): n is a, c, t, g, unknown, or other
  misc_feature (571)..(571): n is a, c, t, g, unknown, or other
  misc_feature (600)..(600): n is a, c, t, g, unknown, or other
  misc_feature (606)..(606): n is a, c, t, g, unknown, or other
  misc_feature (611)..(611): n is a, c, t, g, unknown, or other
cagaactggagctccccgcggtggcggccgctctagaactagtggatcccccgggctgcaggaattcgcacgagaccattacctagaacatcctaatcgaaaaaacaacagcagcccccggggccacagggcgcaggcccgcagccatggaccaggaccacaagaggctagtactcccgtcgccggcgccgcagtccccgccggcatccgccgcgtcggcgtcgaccacggcctcgccgtactccgcgctacaccctctcctcttgccctccccgaacccgcacctcttcctgaagcccaagacgctaactctctccctctcgtcctcctccctcacctccatgtcctcctcctcgctgcccgcccccgtcaccgatgtctgggaggtcgtcacccccactgccccatctgttgaccacgtggacggcgggcttgatgactgcgccatcttcccgccgcggctgcatgaggggctgggncctgacggcgagcccngagaagtcccngcgatgccagcagtggcgaagggaggagaaccgagagatggtgaatacgnagggggaggacaatnaatggctgtggggatgggaaaaggtgcanctttgncggcnaagccccccttgggcggccggtgttcgggatccttcaagaaacggttggctcttgcattggcccgttggggtggcccgggcggtgaagcccccccctgtggggccgggttggg

SEQ ID NO: 39386 - protein, 192 aa, Zea mays
  misc_feature: Ceres CLONE 1429380-F
  misc_feature (117)..(117): Xaa is any aa, unknown, or other
  misc_feature (137)..(137): Xaa is any aa, unknown, or other
  misc_feature (142)..(142): Xaa is any aa, unknown, or other
  misc_feature (152)..(152): Xaa is any aa, unknown, or other
  misc_feature (154)..(154): Xaa is any aa, unknown, or other
MDQDHKRLVLPSPAPQSPPASAASASTTASPYSALHPLLLPSPNPHLFLKPKTLTLSLSSSSLTSMSSSSLPAPVTDVWEVVTPTAPSVDHVDGGLDDCAIFPPRLHEGLGPDGEPXEVPAMPAVAKGGEPRDGEYXGGGQXMAVGMGKGAXLXAKPPLGGRCSGSFKKRLALALARWGGPGGEAPPCGAGL

SEQ ID NO: 39387 - DNA, 688 bp, Zea mays
  misc_feature: Ceres CLONE 1429384-F
  misc_feature: Encodes the peptide sequence at SEQ ID NO. 39388
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaaaaaaaccctaatcgcatctgcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggctacattggcgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacatcgtcctaacaacttctgctggaatttatgaccatgaggaggcccgcccgtagaatgttggtggcaggttctaggtttcttttattgaaaatgtgtttttttgagcacagatgcgtcaagaactcgtctgatgttttgagttttgtaagactgggtgtccaaccctttgtgttttgtaaaacgcgatgttcn

SEQ ID NO: 39388 - protein, 118 aa, Zea mays
  misc_feature: Ceres CLONE 1429384-F
  misc_feature (5)..(117): Pfam Name: Ribosomal_S8 Pfam Description: Ribosomal protein S8
MVRVSVLNDALKSMYNAEKIGKRQVMIRPSSKVIIKFLTVMQRHGYIGEFEYVDDHRAGKIVVELNGRLNKCGVISPRFDVGVKEIEGWTARLLPSRQFGYIVLTTSAGIYDHEEARP

SEQ ID NO: 39389 - DNA, 725 bp, Zea mays
  misc_feature: Ceres CLONE 1429386-F
  misc_feature: Encodes the peptide sequence at SEQ ID NO. 39390
aaagctggagctccccgcggtggcggccgctctatactagtggatcccccgggctgcaggaattcgcacgagaccattacctagaacatcctaatcgaaaaattcactctaagtgcatctcagcccatctgcaccggactgttacgagcttgagtaacgggcgcggcacttggggggggctgtcagattccccttcaggttagctatgaggtgaagctctttaactcgatggagctttgatgatgattcggttagctagctaagccttgttgactacattggtgttcagactgatgagcacgatacctttgtcccccactctgttagcacatgctatgagaagaggtccaggaaggctcggtccccgaggcgtcacaggtgcaggtcctctttcatgatgcactgaaggaactccgcttagaagtcttatggctttgaggatcttctcacaggccatgcatattatccctctctggactgacttgaacccacgtcatgctatcatggagttcattgttaacagctggtctaggtggcgatgctactaagattgtatcctttgagttggtgaggacgcaggctgttaatatctgtactccaagaggcgcgactcaagtcatctccttgctcatcacgggtgtaccttaggttgcggttagaaacgtcaagacaatcgctgagtgtctcgctgaggagctcatcaatgctgataagggatctttcaa

SEQ ID NO: 39390 - protein, 50 aa, Zea mays
  misc_feature: Ceres CLONE 1429386-F
MLSWSSLLTAGLGGDATKIVSFELVRTQAVNICTPRGATQVISLLITGVP

SEQ ID NO: 39391 - DNA, 680 bp, Zea mays
  misc_feature: Ceres CLONE 1429389-F
  misc_feature: Encodes the peptide sequence at SEQ ID NO. 39392
aaagctggagctccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctcctccagtcgatcccatggattaaccacttccacaagacccccgaccgcgagtggttcgagaccgacgcggtgctcagggtcagccctcgcaaacttcctctttctttaccatcctcggccgtcatcatgggcggggataaagggcccggaaggaacccccggggaaagatcccccccccgggggaagggaggggccaaaaacctcccgcggggggaacaccccgccccccccccgtggtctccggggccacaaggggg

SEQ ID NO: 39392 - protein, 142 aa, Zea mays
  misc_feature: Ceres CLONE 1429389-F
MWAASCLASCCAACACEACRTAVGSIGRRSARIAYCGLFALSLFASWALREVAAPLLQSIPWINHFHKTPDREWFETDAVLRVSPRKLPLSLPSSAVIMGGDKGPGRNPRGKIPPPGEGRGQKPPAGGTPRPPPVVSGATRG

SEQ ID NO: 39393 - DNA, 719 bp, Zea mays
  misc_feature: Ceres CLONE 1429392-F
  misc_feature: Encodes the peptide sequence at SEQ ID NO. 39394
  misc_feature (719)..(719): n is a, c, t, g, unknown, or other
aagctggagctccccgcggtggcggccgctctagaactagtggatcccccgggctgcaggaattcgcacgagaccattacctagaacatcctaatcgaaaaacaaaactccccgtttcccatcgcggccactctccttcgagccgtccgccgctcccacccccaccactcgccagctcgccacttcctcccgtctcctcccttccagaggcggcgcgtaagccccgatggccgcctctctcctccacgccgccgccgcctcgctccagagttccacccagcacgcccgcgcgggcgccgccgcctttcaccccctcgcgtgtgccccatccctacgccttacgcgctcctcgttctcgaccaatcgccacctcgagatttcactccgggcgatctcggccagtcgccgtttcgcggggaggggggcaccccgggaccgccacgttgtcgccgccctagcgggggagcaaaccgagggttcagaggtgggggatgacagaaacggggagataaaggccgaggaggctcaggaaatttggaaggtaatgctggagcagttcaaggccgaagccctgcggatgcaggccctgtcaatggcaggcttatgatgtctactccgaagaggaccaaggaaggtcttggctggaagcatcagaaaaagccggaagatacagggcagaaaaaaaccacaaaaaggaccctggaccctggggaacctan

SEQ ID NO: 39394 - protein, 126 aa, Zea mays
  misc_feature: Ceres CLONE 1429392-F
MAASLLHAAAASLQSSTQHARAGAAAFHPLACAPSLRLTRSSFSTNRHLEISLRAISASRRFAGRGAPRDRHVVAALAGEQTEGSEVGDDRNGEIKAEEAQEIWKVMLEQFKAEALRMQALSMAGL

SEQ ID NO: 39395 - DNA, 665 bp, Zea mays
  misc_feature: Ceres CLONE 1429395-F
  misc_feature: Encodes the peptide sequence at SEQ ID NO. 39396
  misc_feature (252)..(252): n is a, c, t, g, unknown, or other
  misc_feature (372)..(372): n is a, c, t, g, unknown, or other
  misc_feature (381)..(381): n is a, c, t, g, unknown, or other
ggagctccccgcggtggcggccgctctagaactagtggatcccccgggctgcaggaattcgcacgagaccattacctagaacatcctaatcgaaaaacacaaagaagctccataattaattattgccctttcagttcgccatcggcagccgagcaccatgagctccacaggcggcgacgatggcgccaagaagtcttggccggaagtggtcgggctcagcctggaagaagccaagagggtgatcctgtgcgnacagcccgacgccgacatcgtcgtgctgcccgtcggcacgccggtgaccatggatttccgccccaccgcgttcgcatcttcgtcgacaccgtcgcggagcaccccacatcggctgagaantcaatctantaaatgaataactcggacatgtcatgcgtgcatgtccgtcgccgataatggatgtgtgtgcttcgtccaataaattgctagtaaaataatggcatcgtcggtatgcatgaattaaatgtatcagaatgttcatcctttcacgatggatattatgaaatgtgctcagttgttttgttcctaaaaaaaaaaaaaaaaagcttatccataccctcaacctcgagggggggccccggacccaattcgccctataaggggtcgtattaccggcgctcactgggccgtct

SEQ ID NO: 39396 - protein, 76 aa, Zea mays
  misc_feature: Ceres CLONE 1429395-F
  misc_feature (11)..(70): Pfam Name: potato_inhibit Pfam Description: Potato inhibitor I family
  misc_feature (32)..(32): Xaa is any aa, unknown, or other
  misc_feature (72)..(72): Xaa is any aa, unknown, or other
  misc_feature (75)..(75): Xaa is any aa, unknown, or other
MSSTGGDDGAKKSWPEVVGLSLEEAKRVILCXQPDADIVVLPVGTPVTMDFRPTAFASSSTPSRSTPHRLRXQSXK

SEQ ID NO: 39397 - DNA, 666 bp, Zea mays
  misc_feature: Ceres CLONE 1429400-F
  misc_feature: Translation starting site: 276
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (637)..(637): n is a, c, t, g, unknown, or other
  misc_feature (666)..(666): n is a, c, t, g, unknown, or other
gctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctaccgggccgccctgagcnnngcgcgcgccgaacgttngaagcttcgctggcagcagctgcagctcn

SEQ ID NO: 39398 - DNA, 707 bp, Zea mays
  misc_feature: Ceres CLONE 1429404-F
  misc_feature (326)..(326): n is a, c, t, g, unknown, or other
  misc_feature (390)..(390): n is a, c, t, g, unknown, or other
  misc_feature (440)..(440): n is a, c, t, g, unknown, or other
  misc_feature (465)..(465): n is a, c, t, g, unknown, or other
  misc_feature (466)..(466): n is a, c, t, g, unknown, or other
  misc_feature (493)..(493): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (651)..(651): n is a, c, t, g, unknown, or other
  misc_feature (656)..(656): n is a, c, t, g, unknown, or other
  misc_feature (685)..(685): n is a, c, t, g, unknown, or other
  misc_feature (687)..(687): n is a, c, t, g, unknown, or other
  misc_feature (688)..(688): n is a, c, t, g, unknown, or other
ctccccgcggtggcggccgctctagaactagtggatcccccgggctgcaggaattcgcacgagaccattacctagaacatcataatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcngacgaagaatggccggaattggcaggaaacatggtggcgcccccctccccggggtggggttttnccccccccccccgggggtggggggggggggcttccccctcccccccctcntccccccccccctccctcttcgccnntcgtcggggggggtggggggggggggngnnnnntttcccctcctccccccccttctcttctctttccccctttttttttgtttgtctggtccgctcttcgtttgcgtgcccccctcctctctcgtctggccgttttgtggtgttctttccgcggcctgcgccggcgcttctggtcggttcttttntcctnctgcccccgctcgcgttctcgtcttcggntnnccgttcgtttctgggtctt

SEQ ID NO: 39399 - DNA, 618 bp, Zea mays
  misc_feature: Ceres CLONE 1429409-F
  misc_feature: Encodes the peptide sequence at SEQ ID NO. 39400
  misc_feature (351)..(351): n is a, c, t, g, unknown, or other
  misc_feature (365)..(365): n is a, c, t, g, unknown, or other
  misc_feature (391)..(391): n is a, c, t, g, unknown, or other
  misc_feature (394)..(394): n is a, c, t, g, unknown, or other
  misc_feature (402)..(402): n is a, c, t, g, unknown, or other
aagctggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcnccctcgtcgtcccnaacgcgcggaggggccggacgggtcntcntcctgtcnggggagaaagcggtgtgtgtacagagcagcgcaacctctgcccagcggatcccgggctacacgtgcagatcatcaccgtctgcgggggagggtgcaccgtggacaacttgcacttctcctggggggaactcccctccaaggaagctcttccacccggcaaatttccagggggtcccctttcaaaaattgggtttaaagggggggccccccttggaa

SEQ ID NO: 39400 - protein, 141 aa, Zea mays
  misc_feature: Ceres CLONE 1429409-F
  misc_feature (53)..(53): Xaa is any aa, unknown, or other
  misc_feature (66)..(66): Xaa is any aa, unknown, or other
  misc_feature (67)..(67): Xaa is any aa, unknown, or other
  misc_feature (70)..(70): Xaa is any aa, unknown, or other
MGEWCFKKRAALVIIVAIISSLQLLLITAQEAGGDHEVWSSSSSPAGGRGGGXLVVPNARRGRTGXXPVXGESGVCTEQRNLCPADPGLHVQIITVCGGGCTVDNLHFSWGELPSKEALPPGKFPGGPLSKIGFKGGAPLG

SEQ ID NO: 39401 - DNA, 722 bp, Zea mays
  misc_feature: Ceres CLONE 1429416-F
  misc_feature: Encodes the peptide sequence at SEQ ID NO. 39402
  misc_feature (722)..(722): n is a, c, t, g, unknown, or other
acaagctggagctccccgcggtggcggccgctctagaactagtggatcccccgggctgcaggaattcgcacgagaccattacctagaacatcctaatcgaaaatcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtgttcaccccgcccccgccgcctgcttctgtgaatgtcgcgctgccgccggtgcaggtgccgccgccgcagtacgagaaggcgtccgcggggggcaagcatgacgtatcggcgttcggcttcttctgggacgccgtcgcgcgcgtccaggaagcgcacgcgagcctcgacgagtacgtgtctacctggttcgggttggatcagtccaagtaccagtgggcgcttaacgactactacgagaccataggcaaggtcagcaaggtcagtgatcttcgaattn

SEQ ID NO: 39402 - protein, 176 aa, Zea mays
  misc_feature: Ceres CLONE 1429416-F
MGSSSSPPPPPPLPLPMIGRAGNLTIFITPPSPASTPRGAGRTPPLESPRSDISTPIPQRAAPSPSLSPSPRNHESRAVAPAVVFTPPPPPASVNVALPPVQVPPPQYEKASAGGKHDVSAFGFFWDAVARVQEAHASLDEYVSTWFGLDQSKYQWALNDYYETIGKVSKVSDLRI

SEQ ID NO: 39403 - DNA, 705 bp, Zea mays
  misc_feature: Ceres CLONE 1429418-F
  misc_feature: Encodes the peptide sequence at SEQ ID NO. 39404
aaagctggagctccccgcggtggcggccgctctagaactagtggatcccccgggctgcaggaattcgcacgagaccattacctagaacatcctaatcgaaaagaacaacttcctgcttgcacgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatccgaattctgaagtcatgggtgcgcttccagtcacagcgtctttagctaacaagctcgcatacatataggcaacttgagtgagctatgtagtacggatatgggttgtgtggcaaaactggccatgactattgacctcccttgcatttttttgacctggggaaagggatcaccccctgcaaaattggggggccctgccctccccccaaaaccttttttttctttaatatacacccgggggc

SEQ ID NO: 39404 - protein, 73 aa, Zea mays
  misc_feature: Ceres CLONE 1429418-F
MIEVVLNDRLGKKVRVKCNEDDTIGDLKKLVAAQTGTRPEKIRIQKWYNIYKDHITLKDYEIHDGMGLELYYN

SEQ ID NO: 39405 - DNA, 809 bp, Zea mays
  misc_feature: Ceres CLONE 1429436-F
ggggtttttgtggccccccccccctgttccctctctcctcttctcccctccgactcgaacgctggcactccccgcgggggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagctatggcggaccgcgaccgcagcggcatctacggcggcgcccactccacctacgggtagtaggagcaggagggaggaggagggcgccctatgggtgagcaggtgaaggtcatgctccacgacaatgggccgacagcgacccacgcgccgacggtgaatagacgctgtgtcccgctcgggggactgtctgctcgtggctgaaagggactggacgccgacccccccccgaaagggggggactgagccgagacacaccgcaggcaattgcctgaatactccaggcccccaaagcgtggggcccccaaccggcgcatgctccactcgggcgacgggccgggcaatagccgtgtccctccaaacaatcaagggctgcgaaaaggaaacgttgtagaggaccatgaggcgcacaaacaccacggcggcgcgccacaccaaacatcagtgttccacacatagtgtcgtttccttttctcgtaccccgacaagaaccaaccgacaataaaagagggccgcgcaccgaaccactaaaaccggcccagaaacgaacccg

SEQ ID NO: 39406 - DNA, 755 bp, Zea mays
  misc_feature: Ceres CLONE 1429437-F
  misc_feature: Encodes the peptide sequence at SEQ ID NO. 39407
ctccccgcggtggcggccgctctagaactagtggatcccccgggctgcaggaattcgcacgagaccattacctagaacatcctaatcgaaaaaacaaattcccgagacgccattctcaccatccacacaaagccacagcccaagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcgggcgaggccccggccgtgatccgggcggcgctggccaaggcgctggccttcttctacccgctggcgggccgcatcgtggagggggagcagccggggcgccccgccatccgctgcaccgccgacggcgtctacttcgcggaggccgaggcggactgcagcctggaggacgtgcgcttcctggagcggcccctgctgctgcccaaggaggacctcgtgccttaccccggcgacgaccgctggcccgtcgagccgcacaacaccatcatgatgatgcagatcacccaagttcccctgcgtgaggctccttgatggggcctgccggtcagccaccccttcctcgtgatcgaatggtcgtcctatacaagtcccacaactgcgtttgagtgaacataggccccccgtggtctgactggtatccaagaggagccctccccgc

SEQ ID NO: 39407 - protein, 152 aa, Zea mays
  misc_feature: Ceres CLONE 1429437-F
MAGFKVTRISEGPVKPASATPEETLPLAWVDRYPTHRGLVESMHIFRSGAGEAPAVIRAALAKALAFFYPLAGRIVEGEQPGRPAIRCTADGVYFAEAEADCSLEDVRFLERPLLLPKEDLVPYPGDDRWPVEPHNTIMMMQITQVPLREAP

SEQ ID NO: 39408 - DNA, 722 bp, Zea mays
  misc_feature: Ceres CLONE 1429439-F
  misc_feature: Encodes the peptide sequence at SEQ ID NO. 39409
  misc_feature (498)..(498): n is a, c, t, g, unknown, or other
agagctggagctccccgcggtggcggccgctctagaactagtggatcccccgggctgcaggaattcgcacgagaccattacctagaacatcctaatcgaaaaagagaaacacctctgagcattctaaagctcatagccctctccttccagagcatttcacatcgctctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagtcatccccgagctcctgcctatcgtcagagaacgagcatgggctgcagtggtccaacagccctgaaggcacatccatgggtcttgctgcctgtcctcgctgcttcatctacgtcatgctcccacagatgaccctcggtgcccccagtgcaagagccctgntctccttgactttctgcaggaacacaccaccgtaagaacaaccgtaataataacccccggaggaaccggaggggattaccaaatgggttcctaaggcgggccgacctcaaaaaaaaaggttttttgaagcctagggcccggaattccaatttggcaaaccttttcctcgggggaaccggggaataacccctctcaaaatgggaaaactcgcccccaaaaaaaaa

SEQ ID NO: 39409 - protein, 99 aa, Zea mays
  misc_feature: Ceres CLONE 1429439-F
  misc_feature (89)..(89): Xaa is any aa, unknown, or other
MSRSNRKSSRGLDLKLNLSLPATGDSSRRAMADEESSPSSCLSSENEHGLQWSNSPEGTSMGLAACPRCFIYVMLPQMTLGAPSARALXSLTFCRNTPP

SEQ ID NO: 39410 - DNA, 727 bp, Zea mays
  misc_feature: Ceres CLONE 1429445-F
  misc_feature: Encodes the peptide sequence at SEQ ID NO. 39411
  misc_feature (392)..(392): n is a, c, t, g, unknown, or other
  misc_feature (433)..(433): n is a, c, t, g, unknown, or other
  misc_feature (523)..(523): n is a, c, t, g, unknown, or other
  misc_feature (580)..(580): n is a, c, t, g, unknown, or other
acaagctggagctccccgcggtggcggccgctctagtactagtggatcccccgggctgcaggaattcgcacgagaccattacctagaacatcctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggctgcactccccgccgacgccttcgccaccgcgctggtcatcttcctcggcgactacaacgatcgcggcccgcacacccgcagggtcctcgacttcctcctcgcgcntccgacgcgctaccccgcgcagcgccacgtcttcctctgcnggcaccacgacctcgcctttcgcgcgttcgtcggggcgctgccgccgccgcccgacggctccccgttctcggccacctgggacgagtacntccacacgaggagcccgagggtgggttccgcgggccgggattcaaggcattgccttncagggaaggcggggggcggggtcttcaggaaaggtggaaccccaaaaggggctcccgaaaaggggtcccttttagaagggggcccccctttaaatctttggggccccccgggtcccccaatttttaaagggtggccaaaagaccaaa

SEQ ID NO: 39411 - protein, 179 aa, Zea mays
  misc_feature: Ceres CLONE 1429445-F
  misc_feature: SWISSPROT Homolog: EC 3.1.3.16 Phosphoprotein phosphatase
  misc_feature (68)..(68): Xaa is any aa, unknown, or other
  misc_feature (82)..(82): Xaa is any aa, unknown, or other
  misc_feature (112)..(112): Xaa is any aa, unknown, or other
  misc_feature (131)..(131): Xaa is any aa, unknown, or other
MSAPSAPPRTVICVGDVHGYITKLESLWSNLQAALPADAFATALVIFLGDYNDRGPHTRRVLDFLLAXPTRYPAQRHVFLCXHHDLAFRAFVGALPPPPDGSPFSATWDEYXHTRSPRVGSAGRDSRHCLXGKAGGGVFRKGGTPKGAPEKGSLLEGGPPLNLWGPPGPPIFKGWPKDQ

SEQ ID NO: 39412 - DNA, 681 bp, Zea mays
  misc_feature: Ceres CLONE 1429448-F
  misc_feature: Encodes the peptide sequence at SEQ ID NO. 39413
  misc_feature (551)..(551): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaaaacctacccagcctcggccagccacctccccgtcgctctcacgctcttcgtgcccgccgcctcccctcttcccctccacctcactcctcccgtctgacgcacatggcatccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgaccacactgaagtttgtggtgaatcgaaattctctgaacttggtgcggattcgctggacacggttgagattgtgatgggcccttgagagcacttcgacattagcgtggaggagtccagcgcgcagacaatttgcaccgntgaagacgccgctgacctcattgacagctttgtgctgtgaaggcatangccgcatctcttctatcattgtcttaacaccctaagtttctatggtctgaaaaactgggaatttccccgacctgctgttgct

SEQ ID NO: 39413 - protein, 97 aa, Zea mays
  misc_feature: Ceres CLONE 1429448-F
MASIAGSSALSFAMPVKAINSNSLAFSPVRKGNTFLRLQPVPMRSVSCAAKKDTVDKVCEIVKKQLALPDHTEVCGESKFSELGADSLDTVEIVMGP

SEQ ID NO: 39414 - DNA, 891 bp, Zea mays
  misc_feature: Ceres CLONE 1429465-F
  misc_feature (47)..(47): n is a, c, t, g, unknown, or other
  misc_feature (752)..(752): n is a, c, t, g, unknown, or other
  misc_feature (891)..(891): n is a, c, t, g, unknown, or other
ggtgggccccgccggggtgtgggtggggggggtgggtgtgggtaaanaaaatcaaaactggactccaccgcggtggcggccgctctagaactagtggatcccccgggctgcaggaattcgcacgagaccattacctagaacatcctaatcgaaaattaactactccgtcattttgtttgcaaagatcctcctcgatccatcaatcactgcaccggccggcggcaccgagatcggaggggctagccaacgagacggcggcaatgggttaccgtgaccgcagcggcatctacggcggcgcccacgcccacctactgggcggcggcgcccgaaggtaggaaggaggactccccaatgggtgaataaggcaaaggggtatgctgcgcctaaaaagggtccaacggggtcctcatgcgcctgacggggggtgccgtctgttccccccctgggcgagtcttgctaccttgtggcgaataagagaaaaggggggttaaacccccctcttggggttgccccccttaagccctgggcccccaaagcggggagagacccggggattctttccagtccccccatggtggcgtccccccggttggggaaaaatatcttgtccttaaccacccacaccacgcgggaggcccctctccctcgggcgcctccgtggacgtccgcttgaggtgttccaccggggagacggggccgactcgtctatccaaggggcccctcccagcaacactatactggccggggtctgnctgtgtaataaatctctacccatccacggtggacaaagggtgcgtggactgagggggcaaaaacgcccgccagaaacagccaacaaacacacccgttatcacaaaaactggggtccgagtacaatgcgacccaccacan

SEQ ID NO: 39415 - DNA, 695 bp, Zea mays
  misc_feature: Ceres CLONE 1429467-F
  misc_feature: Encodes the peptide sequence at SEQ ID NO. 39416
ccccgcggtggcggccgctctatcctagtggatcccccgggctgcaggaattcccacgagaccattacctagaacatcctaatcgaaaaatgtagctctttctggtcccaggagaacgagccgctcgctgatgtgggagcttgtcagcaccgtggatcgcccaaacggccagacgtgatgtctcgcccacgtgtcccttgcccctgtccacctgtcccctccggagcctgcaaagaactcccctccccgctatcatttccggcgcagaaaaggagagtaacactcaacactgcagaaatcagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgcgggcgctggtggccgcggtggcggtagcgagcaacgcgtcgggtgggcacgtcaaccctgcggtcacgttcggcctgctcgtgggccgccgcatctccttcgggcgtgccgcggtatactggctcgcgcagatgctcggcg

SEQ ID NO: 39416 - protein, 116 aa, Zea mays
  misc_feature: Ceres CLONE 1429467-F
  misc_feature (20)..(116): Pfam Name: MIP Pfam Description: Major intrinsic protein
MLPGRHPARRADATGTGPLLPDATRAVVAEFVATAMFVFAAEGSVYGLWKLYKDTATPGGLLAVAIAHTRALVAAVAVASNASGGHVNPAVTFGLLVGRRISFGRAAVYWLAQMLG

SEQ ID NO: 39417 - DNA, 724 bp, Zea mays
  misc_feature: Ceres CLONE 1429473-F
  misc_feature: Encodes the peptide sequence at SEQ ID NO. 39418
  misc_feature (601)..(601): n is a, c, t, g, unknown, or other
  misc_feature (617)..(617): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaatcccacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggcgagcaggcgggaatctccgccgtcatcccaggatggttctccgagatcagccccatgtggcccggtgaggcgcactccttgaaggtggagaaggttctgttccagggcaagtcagactaccaaaatgtgatggtttttcagtcctccacgtacgggaaggtgcttgtcctcgacggagttattcaggtgacagagagggatgagtgcgcgtaccaagagatgattactcacctgcccctttgctccatcaaagaccccaagaaggtgttggttattgaggggattttnggggtgtgtttttttnncggggggtttcgcggtatatctctggtggagcagattgacatctgtgaaattgataagatgggtgggagatgtctccaagcaatttttccctcatctagctgttgg

SEQ ID NO: 39418 - protein, 169 aa, Zea mays
  misc_feature: Ceres CLONE 1429473-F
  misc_feature (43)..(166): Pfam Name: Spermine_synth Pfam Description: Spermine/spermidine synthase
  misc_feature: SWISSPROT Homolog: EC 2.5.1.16 Spermidine synthase
  misc_feature (128)..(128): Xaa is any aa, unknown, or other
  misc_feature (134)..(134): Xaa is any aa, unknown, or other
MEAEAAAKRAREGGEDATAPVAGAEAVVAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIEGIXGVCFFXGGFRGISLVEQIDICEIDKMGGRCLQAIFPSSSCW

SEQ ID NO: 39419 - DNA, 657 bp, Zea mays
  misc_feature: Ceres CLONE 1429475-F
  misc_feature: Translation starting site: 252
  misc_feature (279)..(279): n is a, c, t, g, unknown, or other
  misc_feature (317)..(317): n is a, c, t, g, unknown, or other
  misc_feature (383)..(383): n is a, c, t, g, unknown, or other
  misc_feature (475)..(475): n is a, c, t, g, unknown, or other
  misc_feature (499)..(499): n is a, c, t, g, unknown, or other
  misc_feature (510)..(510): n is a, c, t, g, unknown, or other
aaagctggagctccccgcggtggcggccgctctagaactagtggatcccccgggctgcaggaattcgcacgagaccattacctagaacatcctaatcgaaaagttgtttatcttgcgtccggcgtcctctctctctcgtggcgacgactgggcgacctccccgcccccgccgctctacgccaggtgcccagatcttcgtcgggcccttcgccgaagagcagccaacaggttgccggtctgcgggttgaatcatggcggagcacttggcttcgatcttcngcactgagaaggacaggggtcactgccctttttacttncagattggggcctgtcgtcatggggatcgctgctctcgtctgcacaacaggccaactatatcaccnactcttgtgcttgctaacatgtatcagcgccctgatatggataccccctgagttgatgctcagggccaccctatgaccctgagaagatgcangagcattttgaggacttctatgangacatctatgnagagttggggaagttttgtgagattgagaatctggatgtttgtgataccctgctgacacatggatggggatgtctatgtccagtcaggggagagaacaagccccgcacatcaatgctcttcagggggcttttacctctggccccctt

SEQ ID NO: 39420 - DNA, 645 bp, Zea mays
  misc_feature: Ceres CLONE 1429480-F
  misc_feature: Encodes the peptide sequence at SEQ ID NO. 39421
  misc_feature (390)..(390): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaaattccgtcgtcgtcgtcagcagcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttccctggcgccctcgagccggccgtgtccgtgcagctcggcgacacggccacctcgcctactcccacacaanncaggcgctcctccgccccaggtcgttcgcggccaaggacgaaagtgtctgccctgtcgagggggtgctggacaacctgggtcgtctgagccagcagcacgggctgtcaagcaggggcgcccaacgagtgctcctcgtcatcgaggcctacaagacgctgcgcgaccgcgcgccctacccgggcagcttcatgctcgcccagctcacgggctcctacgccttcgtcctcttcggacagtccaccaaactcctgct

SEQ ID NO: 39421 - protein, 89 aa, Zea mays
  misc_feature: Ceres CLONE 1429480-F
  misc_feature (61)..(61): Xaa is any aa, unknown, or other
MLAVFSGQVVEVPAELVAAGSRTPSPKTKASQLVGRFPGALEPAVSVQLGDTATSPTPTQXRRSSAPGRSRPRTKVSALSRGCWTTWVV

SEQ ID NO: 39422 - DNA, 652 bp, Zea mays
  misc_feature: Ceres CLONE 1429482-F
  misc_feature: Encodes the peptide sequence at SEQ ID NO. 39423
  misc_feature (305)..(305): n is a, c, t, g, unknown, or other
  misc_feature (308)..(308): n is a, c, t, g, unknown, or other
  misc_feature (348)..(348): n is a, c, t, g, unknown, or other
  misc_feature (369)..(369): n is a, c, t, g, unknown, or other
  misc_feature (371)..(371): n is a, c, t, g, unknown, or other
  misc_feature (391)..(391): n is a, c, t, g, unknown, or other
  misc_feature (500)..(500): n is a, c, t, g, unknown, or other
  misc_feature (584)..(584): n is a, c, t, g, unknown, or other
  misc_feature (632)..(632): n is a, c, t, g, unknown, or other
aagctggagctccccgcggtggcggccgctctagaactagtggatcccccgggctgcaggaattcgcacgagaccattacctagaacatcctaatagaaaaaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccnaancactgcttccgggcgcgggccgatggctacctgtactgcnagggaagtgcggtgggagacncnatgacggctgccgagcgcanccccttctacctctacagcaagccacagatcctcccgcacttcgccgccctacgcgatgctctccaggggctccgctccatcatcgggtatgccgtgaaggcaacaacnacctccccgtgctacgcgtcctgcgtgagcttggctgcggcgccctcctcgtcagcggcacgagctccgactcgccctccaggngggattcgaccccgcaggtgcatatttacggaaatgggaagacactcnacatctaaattagctgctgg

SEQ ID NO: 39423 - protein, 180 aa, Zea mays
  misc_feature: Ceres CLONE 1429482-F
  misc_feature: SWISSPROT Homolog: EC 4.1.1.20 Diaminopimelate decarboxylase
  misc_feature (66)..(66): Xaa is any aa, unknown, or other
  misc_feature (80)..(80): Xaa is any aa, unknown, or other
  misc_feature (87)..(87): Xaa is any aa, unknown, or other
  misc_feature (94)..(94): Xaa is any aa, unknown, or other
MASASMLARSLLRTPDPTQTSHPNRRSAAVVSFPRRHRRLSVRASVSTASPSPPPQPAAAAAGVPXHCFRARADGYLYCXGSAVGDXMTAAERXPFYLYSKPQILPHFAALRDALQGLRSIIGYAVKATTTSPCYASCVSLAAAPSSSAARAPTRPPGGIRPRRCIFTEMGRHSTSKLAA

SEQ ID NO: 39424 - DNA, 744 bp, Zea mays
  misc_feature: Ceres CLONE 1429486-F
  misc_feature: Encodes the peptide sequence at SEQ ID NO. 39425
  misc_feature (52)..(52): n is a, c, t, g, unknown, or other
ggggctttccgcggggggggggggaagataatcacaatctgcccgcgccacngtcaaactgggactccccgcggtggcggccgctctagaactagtggatcccccgggctgcaggaattcgcacgagaccattaacctagaacatcctaatcgaaaaaaaccttgcccctgctcctcacgccgccgccgccgccgccgtcgccgccaccacatccgtagcgcccagccgccggagaagaggagggagccagcaccagccaccatgggtcgcgtccgcaccaagaccgtgaagaagacctccaggccggtgatcgagaagtactactcccgcatgaccctcgacttccacaccaacaagaaggtgctggaagaggtctcgatcctcccctcgaagcgcctccgcaacaaggttgccggcttcaccacccacctgatgcgccgcatccagcggggccccgtccgtggcatctcgcccacgctgcaggaggaggagcgggagcgccgcatggacttcctcccggagaagccagcgctctgagggtcgaagagatccgcgtccacaaggagaccaatggagatgcctcacggcacttggcctggcccaatctcccgggcgttaaatcccctcggtttgaagtcacccagcgtcccccgccctaacgggcgccccagcaggaatggagtgttcccccgcccgtggaccggacgctcttaggtttccaccggacggatttggcaaagggg

SEQ ID NO: 39425 - protein, 91 aa, Zea mays
  misc_feature: Ceres CLONE 1429486-F
  misc_feature (1)..(92): Pfam Name: Ribosomal_S17e Pfam Description: Ribosomal S17
MGRVRTKTVKKTSRPVIEKYYSRMTLDFHTNKKVLEEVSILPSKRLRNKVAGFTTHLMRRIQRGPVRGISPTLQEEERERRMDFLPEKPAL

SEQ ID NO: 39426 - DNA, 621 bp, Zea mays
  misc_feature: Ceres CLONE 1429489-F
  misc_feature: Encodes the peptide sequence at SEQ ID NO. 39427
  misc_feature (344)..(344): n is a, c, t, g, unknown, or other
  misc_feature (621)..(621): n is a, c, t, g, unknown, or other
gctctgaactagtggatcccccgggctgcaggaattcgcacgagaccattacctagaacatcctaatcgaaaaaatctctctcttctcctcgcgtcgccttggtgttcactccgtacttagcgcctgccgcgtcgaattttctgtcctccccggtcgccttgctctggtcgtacgacgggcacgtatctgctacccgtgatcgcggtcacaccagtacggcacttccaccccacgcgaacggtgaactcttgaataacagacccgcctctgaggataccctagcgacagctgctcgctacctgtgacattgtccccctcggcccctccatccctgacacagcgnctcccgcctgcttgaagccagcccctattcaagacaatgtcgatcattgctgccttggcaagtcttcatcgctatcaaggtcgagcatggctgctggccagtaaatatagacaacacataacccttcatattaatggacacctctgcatgatcctcgacccggtcacaacaccaggcggacacttccgcatcgccatcaccctcgtcatcactgatggtgaggaggacagcggcacaactcagcatgctccatcattgatctcatctgagcaccgcn

SEQ ID NO: 39427 - protein, 80 aa, Zea mays
  misc_feature: Ceres CLONE 1429489-F
MSIIAALASLHRYQGRAWLLASKYRQHITLHINGHLCMILDPVTTPGGHFRIAITLVITDGEEDSGTTQHAPSLISSEHR

SEQ ID NO: 39428 - DNA, 679 bp, Zea mays
  misc_feature: Ceres CLONE 1429491-F
  misc_feature: Encodes the peptide sequence at SEQ ID NO. 39429
aagctggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccggcggcaagagcgtctaggcccaggagcacctcgccgaatggcgcagccgcggaggccagactcgcagggagcagctggggcagcaggggtacagcgagatggggaaaaagggcgctctgagcaccacggacgagtccggcggcgagcgcgccgccaggggagggcgtcagcatcgacgagtccaagttcaccaagtagtcctatcgggtgcgtgcgtacgcagcgttcgtagctgtctgcgtagtgtaccttggcccgagctagggctactcctctacctttgaagtagctgaaaggaaaatatggaagcttgcagcatggcatgtaggccaataataacatacgtaccgtaactgccgtggaccttggggggtggaac

SEQ ID NO: 39429 - protein, 31 aa, Zea mays
  misc_feature: Ceres CLONE 1429491-F
MASGQESRKELDRKAREGETVVPGGTGGKSV

SEQ ID NO: 39430 - DNA, 779 bp, Zea mays
  misc_feature: Ceres CLONE 1429495-F
  misc_feature: Translation starting site: 233
  misc_feature: SWISSPROT Homolog: EC 2.3.1.144 Anthranilate N-benzoyltransferase
  misc_feature (8)..(8): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
cccccccnggacannnnnnnnntataaaaaacagccctgcaccccacactggagctccccgcggtggcggccgctctagttctagtggatcccccgggctgcaggaatttgcacgagaccattacctagaacatcctaatcgaaaaaccaccaaaccaatcgctggttttgtccagagtatttccggtttcaccgccctagatctgacccgagacgccgcgtcttcgctgagatggcgattactgtgaggcggtctacgatggtgcgcccggcgcgggagacgccgcggcagcggctgtggaactccaacctcgacctcgtggtgccgcgcttccacacgcccagtgtctacttctaccgccgcgacggccccgtgccggatgcggaggggttcttcgacggcgagcggatgcggtgcgcgctggcagaggcgctcgtgccgttctatccaatggcgaggccgcctcgcgcgggacgaggacggtagggtcgagatcgactgcaatggcgagggagtgctcttagtcgaggccgacgcgcccgatgcctctgtcgatgactaccgtgactttcccgcccaccatggagctcaagcgcctcatcccgaccgtcgattacaccgacgacatctcggccttctcgctactcgtgctccaggtgacttatttcaaatggggaggcgtctcccttggtgttgggaatgcaacaccaaggcaccggatgggcatgtctgggcttgcaaattcatttaaactcatgggcctgaccctccagccgag

SEQ ID NO: 39431 - DNA, 601 bp, Zea mays
  misc_feature: Ceres CLONE 1429497-F
  misc_feature: Encodes the peptide sequence at SEQ ID NO. 39432
  misc_feature (341)..(341): n is a, c, t, g, unknown, or other
  misc_feature (342)..(342): n is a, c, t, g, unknown, or other
  misc_feature (384)..(384): n is a, c, t, g, unknown, or other
  misc_feature (567)..(567): n is a, c, t, g, unknown, or other
ctccccgcggtggcggccgctctagaactagtggatcccccgggctgcaggaattcgcacgagaccattacctagaacatcctaatcgaaaaaacgcaggccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccgggagaggaccgtgagggcgcatggccctcagtgctgacgatcatcggctttagattcctaccnnttcactcattcatggctgtgtacaggtcaaatggagatgttngatctatctcctttgtgtctttctctacctgtcctcgttctgctgttctactgcctgcgccgattcgagacaactccaccagagtcgcctagccgggagcacataaaaatggccgtgtgggtactcaccacgatgctcactgctgcgttctcatacaaggtggcagcaattatcccactcccnggtgcagtgctgttgtgggcaatggcaggaccaa

SEQ ID NO: 39432 - protein, 76 aa, Zea mays
  misc_feature: Ceres CLONE 1429497-F
  misc_feature (4)..(4): Xaa is any aa, unknown, or other
MEMXDLSPLCLSLPVLVLLFYCLRRFETTPPESPSREHIKMAVWVLTTMLTAAFSYKVAAIIPLPGAVLLWAMAGP

SEQ ID NO: 39433 - DNA, 651 bp, Zea mays
  misc_feature: Ceres CLONE 1429501-F
tccccgcggtggcggccgctctagaactagtggatcccccgggctgcaggaattcgcacgagaccattacctagaacatcctaatcgaaaagaattttcgaatttctagttcgtctgcgatccaatcgtgtgggggtgctctcgagaatcgttaaacctcgtcagaggttttgctttcacgacacgatggccgcaccgttcttctcaactccattccagccatatgtctaccaggtacgtgtgaacgcatgacccggccagttagtattcatgtgattatgtcatttgataacaattgtaatgcagagtcaacaagatacagtcacacctttccagattttgggtggtgaagctcaagttgttcagataatgttaaagtcagaggagagagtcattgctaagccaggttccatgtgttacatgtctgggtctgttgagatggagaatacatatactcctgaacaacaagttggagtcttacagtggattttcggtaagagtgtaaccagcgttgttcttcggaatactgggccaaacgatgggtttgtgggtgttgctgcaccttaattcgctaggattctaccgattgatttagctatgtttggaggtgagatcttatgccagccagatgcattcctgtggtcggtcagg

SEQ ID NO: 39434 - DNA, 734 bp, Zea mays
  misc_feature: Ceres CLONE 1429526-F
  misc_feature (734)..(734): n is a, c, t, g, unknown, or other
tccccgcggtggcggccgctctagaactagtggatcccccgggctgcaggaattcgcacgagaccattacctagaacatcctaatcgaaaaaccagatctcgaggcagcggagtccggggacaccgttctttccgttgtgcttcctttgcctcttgctgccggtggccggtgattttcccgaggactgtttgggcggcaggcagaggctattttcttggcggatggtgagatggatagccacgccgccgggtccagctccagagggtccggggatggccgcccgtagccaaaaaggagctccaagaaacccccgtattccaagtttactcagcaggagcttccagcttgcaagccgattcttactccaaaaggggctatctcaggtattcggtcgtgttggcgggcttcttgtctcgattggcattgcttccctgccaagcttctcgacgggttgtcgggagcgtttggtcgggatgcgggagggagtggatccatgctcggtggaaatgaccaggttcggttcgatcccgggattcttctcattcccaaaaccctgcggccggtaatctggaagattccgagggaatccacgagtagccacaacatttccgggacttcccacccccgggacggcactcctacccgcattccgtggggagggttactcccaaaacccttctactattatgtcccagccgtaagtttcataacaaatgtagtggtcggatgggan

SEQ ID NO: 39435 - DNA, 789 bp, Zea mays
  misc_feature: Ceres CLONE 1429527-F
  misc_feature (11)..(11): n is a, c, t, g, unknown, or other
ataatatacancttcccccacatccaaatatcaaatactccacctataatattttttttaaacgggacctcgccggggaggcggccgctctataactagtggatccccctggctgcaagaattcgcacgagaccattacctagaacatactaatcgaaaaacaattccgcattcgatccaactcctgagcactttctcctcgtccccgacaagccactcggagccgagatacggccatggactccaccggctccggagcagggggtaaggggaagaagggagcggccggacgcaaggtcggcgggacatagaagaactttgtgtcgaggtccgtgaaggccgggttccagttcccggtcggcgggagtggggcgcttcttgaagaatggccgctactcgcagcgagtccggcgccggcgacccacgaatacctgcgccgctgtccttcggggtgcttgccgccaaataaagggtgggggagggtgccgctgggagaggcttgccagggcacatacctaaggggggctcgtcaataaattcccgcgcccgcggggcgtgggggggggattccaagaacggaacgcaggaagccttgccgaacgctggttgtgggaaggcaatcaaccaatagtacttacaggtagatgctggcgtctcccagatattgcaaccctttggtttcatggctggcagaataaacgaccggtccctaacaaaaggccctccctacatatctcccggcggcctacggaaggcctaataatccggcgcacagggggggggctgggg

SEQ ID NO: 39436 - DNA, 722 bp, Zea mays
  misc_feature: Ceres CLONE 1429534-F
  misc_feature: Encodes the peptide sequence at SEQ ID NO. 39437
  misc_feature (510)..(510): n is a, c, t, g, unknown, or other
  misc_feature (555)..(555): n is a, c, t, g, unknown, or other
  misc_feature (574)..(574): n is a, c, t, g, unknown, or other
  misc_feature (623)..(623): n is a, c, t, g, unknown, or other
  misc_feature (624)..(624): n is a, c, t, g, unknown, or other
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagacgaagagcctgctgttggcgctcagcgtggcggcgctgctcgcggcgcagtcggactcccacggcctgggggacttcacgagcgggagcggcgaggcgacgacgacgccggagatgcagaccttcttcaagccccaggccgctgcggcgctcccggaggccctcgacgcctccatgcccgccaagccggaggcggcggcggcggcgctcccggccacgacaagggccggcacggcgccgtcagccacgccgcgcaggcccgtgtccgtggccgccggcgtggcctgncgcgtggcggccgtggccgtggccggcatcgctgccgccgtggcntacgtggtgcgcggcgcgncgcgcgggaacgaagtgcagctcggctcctcccgtgagccccgtccggnncgggccgcgtgataggccgtcgtcgtcgttaggatctggggtaagcgcgttgttnagcttttgcgatttggtgttttaagtagatctgcagactggtg

SEQ ID NO: 39437 - protein, 141 aa, Zea mays
  misc_feature: Ceres CLONE 1429534-F
  misc_feature (100)..(100): Xaa is any aa, unknown, or other
  misc_feature (122)..(122): Xaa is any aa, unknown, or other
  misc_feature (138)..(138): Xaa is any aa, unknown, or other
MACKTKSLLLALSVAALLAAQSDSHGLGDFTSGSGEATTTPEMQTFFKPQAAAALPEALDASMPAKPEAAAAALPATTRAGTAPSATPRRPVSVAAGVAXRVAAVAVAGIAAAVAYVVRGAXRGNEVQLGSSREPRPXRAA

SEQ ID NO: 39438 - DNA, 747 bp, Zea mays
  misc_feature: Ceres CLONE 1429539-F
  misc_feature: Encodes the peptide sequence at SEQ ID NO. 39439
  misc_feature (44)..(44): n is a, c, t, g, unknown, or other
ggggtgcgggccccccttccccccccggcgcccgccggcggggntgagaaatttcaaactggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcacgcccggtgctcgcgctggtccaggcgcagccgacagcgccgccggatcaccaccactacgccggacccgcgcacaagcgctcgacggcggccaactcgtacacgctggcgctgctggaaccggccgaggagaggtggacgccgctgccgcccccgcctgggccaagccagagccctgcctctgttccggcaggggggccgccgccgacgggaccgccgccggggcagggggaggaagaagggctgcctggagggtgggtccggccggtctggcgacaccgggaaaaccgttggtgccgccccaacgggaacgcgaggaggctcgg

SEQ ID NO: 39439 - protein, 162 aa, Zea mays
  misc_feature: Ceres CLONE 1429539-F
  misc_feature (3)..(50): Pfam Name: F-box Pfam Description: F-box domain
MGDLIPGLPDEVARECLVRVGFDQLPVVRRISRQWKSEVESPDYHRQRRAEGLARPVLALVQAQPTAPPDHHHYAGPAHKRSTAANSYTLALLEPAEERWTPLPPPPGPSQSPASVPAGGPPPTGPPPGQGEEEGLPGGWVRPVWRHRENRWCRPNGNARRL

SEQ ID NO: 39440 - DNA, 491 bp, Zea mays
  misc_feature: Ceres CLONE 1429553-F
  misc_feature: Encodes the peptide sequence at SEQ ID NO. 39441
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
ggagctccccgcggtggcggccgctctagaactagtggatcccccgggctgcaggaattcgcacgagaccattacctagaacatcctaatcgaaaaatcaaccatattattgagaccaacaagcaacatagaaagtggaatccgtagcacaacagagcaacaatggcgaccaagatattttccctccttatgctccttgctctttctgcatgtgttgctaacgcgacaattttcccctcatgctcacaagctcctatagcttcccttcttcccccaatacctttcattaaatgataagcttccaggaatggtgaaaaaccccagcttttttcagcccctatagggctccaacaagcaattcgcagcaagcaacctacctttttcacccgttgggggtnnnntttcttcccacaaaaaaacccnnntttttttttctttccccccccccaaaaaaagaccccccccccccttttttattttttttttttttt

SEQ ID NO: 39441 - protein, 43 aa, Zea mays
  misc_feature: Ceres CLONE 1429553-F
MATKIFSLLMLLALSACVANATIFPSCSQAPIASLLPPIPFIK

SEQ ID NO: 39442 - DNA, 669 bp, Zea mays
  misc_feature: Ceres CLONE 1429554-F
  misc_feature: Pfam Name: ATP-synt_F Pfam Description: ATP synthase (F/14-kDa) subunit
  misc_feature: SWISSPROT Homolog: EC 3.6.3.14 H(+)-transporting two-sector ATPase
  misc_feature (214)..(214): n is a, c, t, g, unknown, or other
aagctggagctccccgcggtggcggccgctctagaactagtggatcccccgggctgcaggaattcgcacgagaccattacctagaacatcctaatcgaaaaaaattcctgtcactgctcgaaatcgatccgatctccgctcgcgctgaagcctgatctccaccgggttcgcagcaggggcgcaggacctcgatcacgagggagcaggggagcancatccacaaccacaagccatggcggggagggcaacatccccactaaacactccgccctcatcgcaatcatcgccgacgaggacaccgtcactggcttcttgatggccgggcgtggcaatgttgatctgcgcaagaaaaccaactaccctcctcgtccacacaagacgacaggttaaacaatcggagatgctttcaaaagatttactacgagggaggatttggctattgtcctcatcagccattaatttgccaacatggatagggttcctgggggaaagctacaaaaagcccgttcctggtttttttggaaactcccttccagggcccctccattttattcccgcgccagacttttggccctccccgaaggaaaaattttttttcccccaaaaaaacggggggcctttaaagggaaaaaaaaaccttttttttgaaaaaccctcctcttttttatt

SEQ ID NO: 39443 - DNA, 810 bp, Zea mays
  misc_feature: Ceres CLONE 1429562-F
  misc_feature (1)..(1): n is a, c, t, g, unknown, or other
  misc_feature (2)..(2): n is a, c, t, g, unknown, or other
  misc_feature (20)..(20): n is a, c, t, g, unknown, or other
nnttggggtgggcccccccngcgggggcggcaactctccgcttatggggcggaagcgagaaaactggtcctccccggggtggcggccgctctagaactagtggatcccccgggctgcaggaattcgcacgagaccattacctagaacatcctaatcgaaaaagctagatcggcgctttgtgtgcgaagctcctgctccatccatcgatcactgcatcggtcggcggttccgcgctcggagggggtgggcaaggaggagacataaatggcggattgagagggcgcaggggtggagggcggcgcgcagaccgccaacggggggacgcggatgcggggcggaggccggcgcgagaggagcggccaggtgaaggaggtgaataacgacaagagggcggaggacactgcaggtcgctacaagcagtgtggcctcccgcgcgcgtggggcatgggctgcgggttgggtggctggagagggccgggaagccccccccaccaaccttggggtgtcgtctgagggccttggagccggcggcccggggaggggacgtacactgttctcaagcaacccaatgtcatggtagatacaggcgcgcgaggtggatagaagtcccccccctgccctggacggggaggggctgacgggcaggggggggggggggggctaaggggattcgggggagaacgggaagagccttctgcgtgggggacattttggcaacggacggcccctcgccgttgcggaatatccaaggggcggcccgcggcatcgcccgggcagggacagaagatcaagcgggggccgcgccgaagg

SEQ ID NO: 39444 - DNA, 726 bp, Zea mays
  misc_feature: Ceres CLONE 1429565-F
  misc_feature: Translation starting site: 461
  misc_feature (512)..(512): n is a, c, t, g, unknown, or other
  misc_feature (513)..(513): n is a, c, t, g, unknown, or other
  misc_feature (596)..(596): n is a, c, t, g, unknown, or other
  misc_feature (616)..(616): n is a, c, t, g, unknown, or other
  misc_feature (702)..(702): n is a, c, t, g, unknown, or other
agctccccgcggtggcggccgctctagaactagtggatcccccgggctgcaggaattcgcacgagaccattacctagaacatcctaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgnncgcgtggcagcaccccgatcctgggccagtgcgtcgagttcctgaagcatcagtgcagcccgacggcgacgccctactgctcngctcagtgccagtcgttgcngcagcattgttgccagcagctcaggcaggtggagccgcagcaccggtaccagcgatcttcggcttggtctccagtccatcctgcancagcagcggcaaagcggcaggtcg

SEQ ID NO: 39445 - DNA, 514 bp, Zea mays
  misc_feature: Ceres CLONE 1429569-F
  misc_feature (215)..(215): n is a, c, t, g, unknown, or other
  misc_feature (216)..(216): n is a, c, t, g, unknown, or other
  misc_feature (218)..(218): n is a, c, t, g, unknown, or other
  misc_feature (356)..(356): n is a, c, t, g, unknown, or other
  misc_feature (357)..(357): n is a, c, t, g, unknown, or other
  misc_feature (371)..(371): n is a, c, t, g, unknown, or other
  misc_feature (383)..(383): n is a, c, t, g, unknown, or other
  misc_feature (396)..(396): n is a, c, t, g, unknown, or other
  misc_feature (397)..(397): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (430)..(430): n is a, c, t, g, unknown, or other
  misc_feature (431)..(431): n is a, c, t, g, unknown, or other
  misc_feature (444)..(444): n is a, c, t, g, unknown, or other
aagtggactcccgcggtggcggccgctctagaactagtggatcccccgggctgcagaattccacgagaccattacctagaacatcctaatcgaaaaaactactccgtcactttgtttgcaaagctcctcctcgatccatcgatcactgcaccggccggcggcaccgcgctcgcaggggctagcaacgagacggcagcaatggcggaccgtgaccnngnccagggcggcatctacggcggcgcccacgccacctacgggcagcagcagcagcagggaggaggcgggcgccccgaaaggggggaaacaagggggttaaaaaaagggggggggggtttttttttttttctttccccccnnaaaaaaaaaaaaanaggggggggggnggggggccccacnnccccnnnncgcggccgcgggcgggcgcgggggnnggcccgcgggcgnaacaacccccccccgggggggggggggttcatccccccgcgcgggggggggttttttttttggggggggg

SEQ ID NO: 39446 - DNA, 731 bp, Zea mays
  misc_feature: Ceres CLONE 1429571-F
  misc_feature: Encodes the peptide sequence at SEQ ID NO. 39447
  misc_feature (52)..(52): n is a, c, t, g, unknown, or other
  misc_feature (61)..(61): n is a, c, t, g, unknown, or other
aaagctggagctccccgcggtggcggccgctctagaactagtggatcccccngggctgcanggaattcgcacgaagaccattacctagaacatcctaatcgaaaaatcgaacgcacactcgcactcgcacgtacaccacactagttaccacagacgacgggcgccatgaaagtcccggtgcttctcctcctggtctccctgtgcttctcgctcgcgctcgcgtggcaaacggacacggaatcgggctcaggcaggccgtaccactacggcgaggagagtttccggcactggacgcgctcccggcagggccggttcagggtgctggaacggttcacccacgagctgctggaggacgccgtcggcaactaccgcgtcgccgagctggaagccgcgccccgcgcgcgttccctgcagccccagcaactaacgatgcccgacgaaggtgattgttcgtgaaaaggaagccaaggggcttcatcgtggctgcttcgccgggcgggaagagggaattgtttcttgcgtccagggagggccaacctcttggtcatccccgggggggccccttttttgtatttcggccaaaaccccccattggggagagggtcccccggtgtttatggttcctaaacccccgttgttttccaggttggggacctttcggaggaattttttcccccttcggaagggaaaaacccccagaacctttttccaagggtttttagggagaaaaa

SEQ ID NO: 39447 - protein, 96 aa, Zea mays
  misc_feature: Ceres CLONE 1429571-F
MKVPVLLLLVSLCFSLALAWQTDTESGSGRPYHYGEESFRHWTRSRQGRFRVLERFTHELLEDAVGNYRVAELEAAPRARSLQPQQLTMPDEGDCS

SEQ ID NO: 39448 - DNA, 667 bp, Zea mays
  misc_feature: Ceres CLONE 1429580-F
  misc_feature: Encodes the peptide sequence at SEQ ID NO. 39449
  misc_feature (577)..(577): n is a, c, t, g, unknown, or other
ggagctccccgcggtggcggccgctctagaactagtggatcccccgggctgcaggaattcgcacgagaccattacctagaacatcctaatcgaaaaccctttccttccgccgcccaaatgccagtggccaccttcctcctcgtcgcgcttctctcgtgcggcgcacgagccatccggacgcacggcggctatgtctccgcggtcggggaccccggcatgcggcgcgacggcctcggcgtggcatgggaggcgtggaacttctgcaacgaggtcggccaggaagccccccggcatgggcagcccccgcggtgccgattgcttccatcttctccagacgagctccgacgaagaggggcggccggtgtactcggtggcccacctggtgagcgaccccaacaccgcctgggcgccggcgacccgttcccgggtccccgccgggcgcggcccgggtcacggacccaacctctacccccggccaaggacttttcctaggcgaccgctggcaggtggcccacccccccggccctgggcagttctgggatggcatgctcaaaaacggaacctcaaaccccccgcncccccttgccagaaaaagggcccccccggcccccttccccgaaaactccccttttcccgtgcccgccggggccggggtgataaaccaacc

SEQ ID NO: 39449 - protein, 124 aa, Zea mays
  misc_feature: Ceres CLONE 1429580-F
MPVATFLLVALLSCGARAIRTHGGYVSAVGDPGMRRDGLGVAWEAWNFCNEVGQEAPRHGQPPRCRLLPSSPDELRRRGAAGVLGGPPGERPQHRLGAGDPFPGPRRARPGSRTQPLPPAKDFS

SEQ ID NO: 39450 - DNA, 668 bp, Zea mays
  misc_feature: Ceres CLONE 1429582-F
  misc_feature (98)..(98): n is a, c, t, g, unknown, or other
ggagctccccgcggtggcggccgctctagaactagtggatcccccgggctgcaggaattcgcacgagaccattacctagaacatcctaatcgaaaatncaaccatattattgagaccaacaagcaacatagaaagtggaatccagtagcaacaatagagcaacaatggcgaccagatattttcccctcttatgctccttgctctttcacatgtgttgctaacgcgaccattttcctcaatgctcacaagctctatagctcccttctcccccataccttcatcaatatagcttcatatgtgaaaaccagctcttcaccatataggcttcacaagcaatcgcagcaagcacatacctttatcgccgtggtggttcacaatcgccagccctatctttggtgcagtcatgggtacaaaccatcagggcaaacagctgcagcaactcgtgctacctctgatcaaccaagtactctggaaaaactttctccctactctcaacaaaaaaaatttctcccattcaaccaactgtctacactgaaaccttgttgcttatttgcagcaacaactattaccattttagccagggtgggtattgtcttactctcaaaaaaaaacaatttcttccatttaaacaaattgggccccactgaaaccccgcctgctttaattac

SEQ ID NO: 39451 - DNA, 710 bp, Zea mays
  misc_feature: Ceres CLONE 1429586-F
  misc_feature: Translation starting site: 205
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtcgggcgcgctggggctcgggggcctgtcctcgctcacgtgcctcgccaacacggcgcggcaggcgttccagcgcaccccggactacgtggaggaagcgcaccgcaggatggcggaagccgcggcgcacgcgggccacaagaccgcgcaggcaggccaggccatccagggcagggccaaatnnnnnnn

SEQ ID NO: 39452 - DNA, 658 bp, Zea mays
  misc_feature: Ceres CLONE 1429588-F
  misc_feature: Encodes the peptide sequence at SEQ ID NO. 39453
  misc_feature (217)..(217): n is a, c, t, g, unknown, or other
aaagctggagctccccgcggtggcggccgctctagaactagtggatcccccgggctgcaggaattcgcacgagaccattacctagaacatcctaatcgaaaaccccccccatctctcctcccctccccatctcgctcttgcggagatcgaagagaagctgaggcctagcgccgcacccgccgccgcatcagccatcagccatggcgatgggcgctcngctcgtctcgcgctcccgtcagctacattcggtttcagcagcttttgcgaatggagtgcccactcagttcgctcccttgccaggatgcagctccagctgaccgtcctcctgtgggtggggatgatctcctgaagggcatattctttgaggtaaagaggaagtttgagacagctctcggcgtccttaaaaagaaaagatcactattgatccagatgacccggggcagtttctcaatatgctccattcatgaagactgtaagggaaaggctgatcttctttctgattctccaaggataaaatatacccttgagactttccccaggggatccctagagccgggactttcttgaatactcttccacgctcagaataaagaggggccttatagatcatatggaatccaaccctttgaggagggagcctccttgaaaaattgaaaag

SEQ ID NO: 39453 - protein, 99 aa, Zea mays
  misc_feature: Ceres CLONE 1429588-F
MECPLSSLPCQDAAPADRPPVGGDDLLKGIFFEVKRKFETALGVLKKKRSLLIQMTRGSFSICSIHEDCKGKADLLSDSPRIKYTLETFPRGSLEPGLS

SEQ ID NO: 39454 - DNA, 641 bp, Zea mays
  misc_feature: Ceres CLONE 1429589-F
  misc_feature: Encodes the peptide sequence at SEQ ID NO. 39455
  misc_feature (78)..(78): n is a, c, t, g, unknown, or other
  misc_feature (357)..(357): n is a, c, t, g, unknown, or other
  misc_feature (362)..(362): n is a, c, t, g, unknown, or other
  misc_feature (444)..(444): n is a, c, t, g, unknown, or other
ggagctccccgcggtggcggccgctctagaactagtggatcccccgggctgcaggaattcgcacgagaccattacctnagaacatcctaatcgaaaaaagggccaaggcagggcactgcactgcacgcatgcactgacctgacgacgacgcgcgccacagtccacagctccacactcagacatggcgatgggcgccgcttccatcctactgatgatggtttcgctggaggccctgcttctcgccgccgccgccggcgccggcgggaccatccgtctgcccagcgatgtcggaggcgttgctgcagaccttgtcacggcgatggcgagggcgagggcaagggcaaagcatcagcttcncaacnaagagaggccgtggggggaatgctgcaacttggccgtatgcgtcaagacgtacccgctaacttgctcgtgcttcgatcgggntgagcgctgctccgacccctgtaaaggagtgcgtggaaaacggaggaatccccgccacgtcttgcgtcaaacagggaccggggccaaacccgggggccccgggtgccccccaacaaagaacgggagggaaggggcgaacccccttaaaaaaaaaccttggggtggcaaaaccccccccccaccgcctttgattgcaa

SEQ ID NO: 39455 - protein, 153 aa, Zea mays
  misc_feature: Ceres CLONE 1429589-F
  misc_feature (59)..(59): Xaa is any aa, unknown, or other
  misc_feature (61)..(61): Xaa is any aa, unknown, or other
  misc_feature (88)..(88): Xaa is any aa, unknown, or other
MAMGAASILLMMVSLEALLLAAAAGAGGTIRLPSDVGGVAADLVTAMARARARAKHQLXNXERPWGECCNLAVCVKTYPLTCSCFDRXERCSDPCKGVRGKRRNPRHVLRQTGTGAKPGGPGCPPTKNGREGANPLKKKPWGGKTPPPPPLIA

SEQ ID NO: 39456 - DNA, 802 bp, Zea mays
  misc_feature: Ceres CLONE 1429593-F
  misc_feature: Encodes the peptide sequence at SEQ ID NO. 39457
  misc_feature (45)..(45): n is a, c, t, g, unknown, or other
  misc_feature (726)..(726): n is a, c, t, g, unknown, or other
ggggggtgtggggtgtgttgtggggtggatgttttcccaccgccngggggtcaaactggaactcacctcggtggcggccgctctatactagtggatcccccgggctgcaggaattcgcacgagaccattacctagaacgtcctaatcgaaaaaagacgatctgcgaaacaaacactagtgcgtttgcgagagaaaccgagaaagagaagctacagagtcactgaccgaccgctatggcatcgaggcagaacacgcgtgaggcgcgcgccgaggccgacgcgcggcgcgccgtggaggagctggctcgggcgcgggacgagcacctcgagaaggcggatgtgaacgcccgctcggtcgtgggaggagatcgagcggcttcccgcgccgaccgcggtgccttcggtgggcggcgggcttcctgggagagcttgtagggagggcgcccaggtccatgggcccagcgccgcggggccgcacccttcagttggcgcccaagggacgcgaaccggtgggaccagaacctgcgcaggaacgggggcaaaaccgcgggggcggaccaagcctcggggcgaagttcccggggaacgaccccctgcccgacacagggccgcgggggagggcccaaaggacagggggtcctccgccgtaaagaaggaggacaaaaaccggccgaaatgcccaacccccgaaaacaaagcctgggcgtccagttaatatggtcacgcncccccctcgcacaaaacggcaaagtcaaaaacccaaaggaattcgggtgggtctcccaaaaaaatacaagcggaag

SEQ ID NO: 39457 - protein, 66 aa, Zea mays
  misc_feature: Ceres CLONE 1429593-F
MASRQNTREARAEADARRAVEELARARDEHLEKADVNARSVVGGDRAASRADRGAFGGRRASWESL

SEQ ID NO: 39458 - DNA, 662 bp, Zea mays
  misc_feature: Ceres CLONE 1429595-F
  misc_feature: Encodes the peptide sequence at SEQ ID NO. 39459
  misc_feature (90)..(90): n is a, c, t, g, unknown, or other
  misc_feature (128)..(128): n is a, c, t, g, unknown, or other
ggagctccccgcggtggcggccgctctagaactagtggatcccccgggctgcaggaattcgcacgagaccattacctagaacatcctaantcgaaaaaaaaaaaaaaattatccacggcggcggtggncggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctggggtcatggatgtcatttccatccccaagaccaatgagaactacaggctgctgtacgataccaagggccgcttccgccttcaccaatcagggatgaggatgctaagttcagccttgcaaggttaggtctgttcagtttggggagaggggcatccttttctgaacacgtatgaacggccgaacatccggtaccctgaccccctcatgagg

SEQ ID NO: 39459 - protein, 125 aa, Zea mays
  misc_feature: Ceres CLONE 1429595-F
  misc_feature (3)..(40): Pfam Name: RS4NT Pfam Description: RS4NT (NUC023) domain
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGVMDVISIPKTNENYRLLYDTKGRFRLHQSGMRMLSSALQG

SEQ ID NO: 39460 - DNA, 669 bp, Zea mays
  misc_feature: Ceres CLONE 1429596-F
  misc_feature: Encodes the peptide sequence at SEQ ID NO. 39461
  misc_feature (415)..(415): n is a, c, t, g, unknown, or other
aagctggagctccccgcggtggcggccgctctagaactagtggatcccccgggctgcaggaattcgcacgagaccattacctagaacatcctaatcgaaaagtccgccccagtctaatccgattcaaaccgcccgttccccgtgtccgtgccaagcaagccgagcccaacccccaagagccagctgctcggtgctccacgcgatggcgcagaaggagactaatggcagcaacggcgatcacatctccacccgcccgccgccgaccccctcgcccctccgcttctccaagttctttcaggctaacctgcggatcctggtcactggtggggcgggcttcatcggctcgcacctcgtagacaagctcatggagaacgagaagcacgaggtcattgttgctgataactttttcactggntcaaaagacaccctgaagaagtggattgcccacccagatttgagctcatccgtcatgatgtcaccgagccgctttcttgtggaagttgaccaaatctatcaccttgcttgccctgcttcaccaatcttctacaagcacaaccctgttaagaccatccaggacaaatgttattggtacccctgacatgctaggactggcaaagagagttggaacctaggattttgttgaactcaacctctgaaagtttatggtgg

SEQ ID NO: 39461 - protein, 131 aa, Zea mays
  misc_feature: Ceres CLONE 1429596-F
  misc_feature: SWISSPROT Homolog: EC 4.1.1.35 UDP-glucuronate decarboxylase
MAQKETNGSNGDHISTRPPPTPSPLRFSKFFQANLRILVTGGAGFIGSHLVDKLMENEKHEVIVADNFFTGSKDTLKKWIAHPDLSSSVMMSPSRFLVEVDQIYHLACPASPIFYKHNPVKTIQDKCYWYP

SEQ ID NO: 39462 - DNA, 607 bp, Zea mays
  misc_feature: Ceres CLONE 1429597-F
  misc_feature (67)..(67): n is a, c, t, g, unknown, or other
  misc_feature (74)..(74): n is a, c, t, g, unknown, or other
  misc_feature (77)..(77): n is a, c, t, g, unknown, or other
  misc_feature (78)..(78): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (110)..(110): n is a, c, t, g, unknown, or other
  misc_feature (117)..(117): n is a, c, t, g, unknown, or other
  misc_feature (506)..(506): n is a, c, t, g, unknown, or other
  misc_feature (510)..(510): n is a, c, t, g, unknown, or other
  misc_feature (527)..(527): n is a, c, t, g, unknown, or other
caagctggactccccgcggtggcggccgctctagaactagtggatcccccgggctgcaggaattcgncacgagnacnncattaccnnnagaacatcctaatcgaaaaaancctcatnccttctctccttttgctcggaacgcacacaccgcccggtctccgatctccgatccccgatcccctcgtcgatccagatgcagatcttcgtcagactctcactggaaagactatcaccctcgaggtggagtcctctgacaccattgacacgtcaagggccagatcccagacagggaaggcatccccccggacagcagcgggctcatctttcgcttgcaaagcaagcttcgagaacgggcgccaccttttgcgaactaaccaatttcaggaaggaaaagccccctccccctttggtcccccccccccaggggaaagcatgccaaatttttccttcaagacacctccccggggaaaaaactttcccccccccgaggggggggaatctttttntggncaccccttcccaaaaancgctcagggggcccaaaacccccggagaaaaagggaggggggtattccccccccgggaaaaaaaaaggggggtttttttt

SEQ ID NO: 39463 - DNA, 740 bp, Zea mays
  misc_feature: Ceres CLONE 1429598-F
  misc_feature (17)..(17): n is a, c, t, g, unknown, or other
  misc_feature (48)..(48): n is a, c, t, g, unknown, or other
  misc_feature (56)..(56): n is a, c, t, g, unknown, or other
  misc_feature (740)..(740): n is a, c, t, g, unknown, or other
ttttttttttttttttntttttgctcgccccggcccgccccgcggggngttttttnttttcaagctggagctccccgcggtggcggccgctctagaactagtggatcccccgggctgcaggaattcgcacgagaccattacctagaacatcctaatcgaaaaacaaacccaacttccaccagacccctaaccttttcgcagctccagcgcacagccgccgccgtttcttcatcttcttcgcagagccggcgctccatcttcggctccctcccttacttgcgctcggcacgcaggcggcgctgtggctcgggatctcagtgacggcatcaagggcttcccctcccgcctctcgccagtcgcctccggtcctccgcacaccggccggtgatctctctcctcccgcctccggtggatcgtcaacggcgcccggccccggcggctgcgtcgcgcgcgtcctgagggcagctgcaggcgctgctcgactaaggcggtcgcgccgctttgggagcggtttatgccccaaagtgaagcgtgctcttagtggcgctcctttggaaccctggtaatgggtactgctgttaaatgggctcaacccttcagtcatttctaggcaactggcaagtttatggatccacaccaatcagaattttttgggaaagcccaaagtaggcgggtcccgctggtttacccgcccacttatttccaggtaattccaaggaactccttcaaagattttaaan

SEQ ID NO: 39464 - DNA, 628 bp, Zea mays
  misc_feature: Ceres CLONE 1429601-F
  misc_feature (349)..(349): n is a, c, t, g, unknown, or other
  misc_feature (368)..(368): n is a, c, t, g, unknown, or other
  misc_feature (371)..(371): n is a, c, t, g, unknown, or other
  misc_feature (391)..(391): n is a, c, t, g, unknown, or other
  misc_feature (400)..(400): n is a, c, t, g, unknown, or other
  misc_feature (406)..(406): n is a, c, t, g, unknown, or other
  misc_feature (413)..(413): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (620)..(620): n is a, c, t, g, unknown, or other
aagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcacaaatggccgccgtcgagtccaggtcccgactgccgctcccgtcgaggaggctgcccagctggccgccgcctccgccgtcgagaccccgaaacgagagaccgctgctccggcngatgagaccgaggtcgtcntcnctaaagagccggagcccgtngaagccaanactganactgagnaccagggagcccaagcccttggctaaccccacccgaggcaaaaccccaagaaaacaaaacccggggggccccccccccccccnnnnnnnaaaaaaaaggggggttctaaaaaaaaaaaaaaaaaagagagggcccccccccccccccccccccccaagaaaaaaaaaaaaaagggaggggggtgtttttttttttctcccctcctcncgccgggg

SEQ ID NO: 39465 - DNA, 720 bp, Zea mays
  misc_feature: Ceres CLONE 1429603-F
  misc_feature: Encodes the peptide sequence at SEQ ID NO. 39466
  misc_feature (539)..(539): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccccgtggaggcgaagcangcgctctactcgagggacctcgctcgcaacctgcgcttcgcctccaacttcgacctcttcaaggctgctgcggccgactggcgcgacacgctctttctgcgnagtggctccgaacccgccgccgcgggaggagctgccggagccactcaggaacgtgatgctggagtacagcgcggcggtg

SEQ ID NO: 39466 - protein, 191 aa, Zea mays
  misc_feature: Ceres CLONE 1429603-F
  misc_feature: SWISSPROT Homolog: EC 1.14.11.20 Desacetoxyvindoline 4-hydroxylase
  misc_feature (131)..(131): Xaa is any aa, unknown, or other
  misc_feature (165)..(165): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPPWRRSXRSTRGTSLATCASPPTSTSSRLLRPTGATRSFCXVAPNPPPREELPEPLRNVMLEYSAAV

SEQ ID NO: 39467 - DNA, 734 bp, Zea mays
  misc_feature: Ceres CLONE 1429604-F
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaactgaccgcctccctcgcctggtattcctggaggccgccgcctccaagcttctccctcccacgtgtgcttctctccctcccttcccttctctctgctgcgcacgtcggcctctagctcgtggagctccctcctctccctccacctctcctcccatggcgcgtcctctagctctggtgccgcgcgcactccttccctattgccgcgcgtgccccatctccctccacgcgcccctggctcggaccccggctcggccttctccccagtgcccggccggagctccctggctcgcccctgcgctcgcccagcccctgctcctcgctcctcccggcgcccagccgagctcgcccccggccccttgctcctccatggccggcgtttccccggcttgggtctcaccaaggtcgcccgccgtttccctgtgccgaggtctcgcccagccacaaccccgctcgacttggccgcgacctcgccgtggatgccgtcctcgcctcgccctacggncaactttcgcggtcgagttcctctgcccctctccacgacccgcgtcgattctctctagccggtgcgcggacggcgcccctgctcctgctcgccatggctgccatgccctcccagcagcagagctcgcgcgc

SEQ ID NO: 39468 - DNA, 677 bp, Zea mays
  misc_feature: Ceres CLONE 1429614-F
  misc_feature: Encodes the peptide sequence at SEQ ID NO. 39469
aaactggagctccccgcggtggcggccgctctagaactagtggatcccccgggctgcaggaattcgcacgagaccattacctagaacatcctaatcgaaaaactccatccattcacaaagagcgttcctttctgttttctctctcctctcttatttctcttttttttttcctttttttcttttttttttcttttttttcttcctttcgtttttttttgtttctctcttcgttttagttgatttcgaaccctaagctaaaaaggggaaagaggtctttttctcgggaaacaaaacagatatttttccatctcaaaaaagatgcagaatccgaggctcaaacaacagcagcaacagcaacaacaagctatgatgcagcaagcgttgatgcaacaacaccactctctctatcatcctagccttatggctcctcctccccctcctcagatggagcctctaccaagtggaaaccttccccctggttttgatcccactacttgccgcagtgtgtatgctggcaacatttccacccaggtcactgaggttcttcttcaagagatttttgctaccaccggccctgttgagagctgtaaactcatcagaaaaggataagtcatcatatggaatttgtcactacctttgatccaaaatctgctggtttggctatcatgtctctaaac

SEQ ID NO: 39469 - protein, 96 aa, Zea mays
  misc_feature: Ceres CLONE 1429614-F
MQNPRLKQQQQQQQQAMMQQALMQQHHSLYHPSLMAPPPPPQMEPLPSGNLPPGFDPTTCRSVYAGNISTQVTEVLLQEIFATTGPVESCKLIRKG

SEQ ID NO: 39470 - DNA, 745 bp, Zea mays
  misc_feature: Ceres CLONE 1429624-F
  misc_feature: Encodes the peptide sequence at SEQ ID NO. 39471
  misc_feature (327)..(327): n is a, c, t, g, unknown, or other
  misc_feature (338)..(338): n is a, c, t, g, unknown, or other
  misc_feature (411)..(411): n is a, c, t, g, unknown, or other
aagctggagctccccgcggtggcggccgctctagaactagtggatcccccgggctgcaggaattcgcacgagaccattacctagaacatcctaatcgaaaacccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccggtggcgtcctgngcgagatgcangggtacagaagactgagatctgccagacatgttttgcagctaaagatgtctgccaggtctgcctgctggatcnttgatatggtctgccctgtcaggtccgagatacagcactctctatcattccaatgatgcattccaaggagtgatgccaatcgcgaatattttgcaaagagcctgattgggaggcccgaactggcataaacttggatcctcctatggggagggtccgtcaaatggatcatttttgaagctccgagggaaccccctttttccaaaggggaccagctctggtttgccgtttctttgtgcgggggaaattccaaaagggccggggggcccctttcctccaagaaagcccaaaacgggggagtttttcccccaaacattaaaagcccctcctgggggga

SEQ ID NO: 39471 - protein, 86 aa, Zea mays
  misc_feature: Ceres CLONE 1429624-F
  misc_feature (59)..(59): Xaa is any aa, unknown, or other
  misc_feature (63)..(63): Xaa is any aa, unknown, or other
MAHRLLRDAQADGWERSDFPIICESCLGDNPYVRMLRAEYDKECKICARPFTVFRWRPXRDAXVQKTEICQTCFAAKDVCQVCLLD

SEQ ID NO: 39472 - DNA, 781 bp, Zea mays
  misc_feature: Ceres CLONE 1429627-F
  misc_feature (631)..(631): n is a, c, t, g, unknown, or other
  misc_feature (732)..(732): n is a, c, t, g, unknown, or other
  misc_feature (760)..(760): n is a, c, t, g, unknown, or other
aagctggagctccccgcggtggcggccgctctagaactagtggatcccccgggctgcaggaattcgcacgagaccattacctagaacatcctaatcgaaaaaatcacccccaggtcttcctctcgcgagttgcggtctcgcgcccccctccgccgaccgccgcctcctcacaaccgcggaagctgcttccctctccattggacgcggccagcttccatctctcggtcacctccctctacatcccacggccgctaccaccttccctctacctcacacggccgccgggcctctccaaggtctgcacacgcagggaaaaccttgccacgagtccccgacactccatccccggaagagctaacgaggggactccccaccgcgcccttgggtggagggcggggactcctttctccctcaccaccttcactcccatctggggaacttcatgcaaattggagcgcggggctcccggggggcgcgatccggggcagaactcccctctgggaatcgaacctggacaaggggtgtaattcttgggccctcgggaaaaagcgcgccgcctctctttttcagtggaaaaaaaacctcactgggggaaaaaaattccgcggcacccgcgccctcgggggagcgngcggcgtcctccctcaggggtggcgagaggggccgggtgggcccccggacttcggcggaggctcgcgcaagggggagcgagggagaaagctggggcgcganatcacgggcgggccggggggcgcggganacccaacaacaacgggcgggg

SEQ ID NO: 39473 - DNA, 727 bp, Zea mays
  misc_feature: Ceres CLONE 1429629-F
  misc_feature: Encodes the peptide sequence at SEQ ID NO. 39474
  misc_feature (611)..(611): n is a, c, t, g, unknown, or other
  misc_feature (644)..(644): n is a, c, t, g, unknown, or other
  misc_feature (727)..(727): n is a, c, t, g, unknown, or other
aagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaacctgccgtgacctttcgcgccttcgtgggcgggcacatcaccctggtccggggggctctgtactgggtgccgcagctgctggggtccaccgtggcgtgcttcctgctccgcttctcgacgggcgggcaggccacgggcaccttcgggctgacgggcntgtcggtgtgggaagcgctggtgctggaaatcntgataacctcgggctggtgtacacgtgtacgccacggcggtggacccgaagagggcaacctgggcaccatccccccatgccan

SEQ ID NO: 39474 - protein, 175 aa, Zea mays
  misc_feature: Ceres CLONE 1429629-F
  misc_feature (13)..(174): Pfam Name: MIP Pfam Description: Major intrinsic protein
  misc_feature (138)..(138): Xaa is any aa, unknown, or other
  misc_feature (149)..(149): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVKPAVTFRAFVGGHITLVRGALYWVPQLLGSTVACFLLRFSTGGQATGTFGLTGXSVWEALVLEIXITSGWCTRVRHGGGPEEGNLGTIPPC

SEQ ID NO: 39475 - DNA, 723 bp, Zea mays
  misc_feature: Ceres CLONE 1429638-F
ggagctccccgcggtggcggccgctctagaactagtggatcccccgggctgcaggaattcgcacgagaccattacctagaacatcctaatcgaaaactctctgttgcatttcccgtcctgtccttccacccggcggcttaaaccctagttctcactcccatcgccgcttcagctccgccgctgcacatggagttctggggcgctgcacgcgaagccgcgcttgcttgagccgcgctgggtcgggggcggggcccgctgctgggttggtggaaccctatccctgacgtgagcgactcgcacatcccgcagctaggctggtgggcgctggggcatgctaaccaccagaagctggccccccagtggctgcggttcgaccgcgtggagcgcggtgagcagcatgctcctgtccgggatgaactaccgcctctacatcgacgccgccgaccccgccggacgaacacgagacctacggctgcatccggtacaagcaggtctggacccgcagctgccggatcgcctccttcagcccggtgccccgcgcccactgaaaccatacccacacgggggggaccaagcgacgttctccgccaattaggtgtatagctaaacttagtgtggttgctataatgatgataatgcatctccctgactcgatggacctagaggtatctacttgtatggtagcaagggaccctgtccaccggggagttacaataatgtggg

SEQ ID NO: 39476 - DNA, 826 bp, Zea mays
  misc_feature: Ceres CLONE 1429639-F
  misc_feature: Encodes the peptide sequence at SEQ ID NO. 39477
  misc_feature (522)..(522): n is a, c, t, g, unknown, or other
tggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccagggtgctcgacttgtcgggggcggacgcttggaaccgggtagtgcgtgcatccccttggatgctgcttcagccatcgtccgacccacttacaacccgcgttcgccccgcgaacaccccgcaaggcgcggtcgttccggcgtccctccttcggcaacctcatccccgcggggtcccgtcgaatgttcacccaaactccctaccccccgtgccccgtttggaaaggaggaatgaaccaaggaatccctaagggaatcttgggttccctttngacccaccaatttacccaccggagttcaaatggtttctccccttgtttccaaagaaggaatttaaatgccccaagggaaaccatggtttgttttgggctgggtaacagccacctgggcccccaaaaacttaagggggaggaacgcacctttgggatggtccaattgccatttatttcaaccaggtttattggtttccctaataccccaggccttggggggggatttatttggaatgtccccaaacccccaaggggagcctgtgggtttaacccgcaacccaaaaggggttactttccttctttt

SEQ ID NO: 39477 - protein, 116 aa, Zea mays
  misc_feature: Ceres CLONE 1429639-F
MASSDGKPLPTPASVGGGGGSSTAPPGQPTTVASRVLDLSGADAWNRVVRASPWMLLQPSSDPLTTRVRPANTPQGAVVPASLLRQPHPRGVPSNVHPNSLPPVPRLERRNEPRNP

SEQ ID NO: 39478 - DNA, 674 bp, Zea mays
  misc_feature: Ceres CLONE 1429640-F
  misc_feature: Encodes the peptide sequence at SEQ ID NO. 39479
  misc_feature (363)..(363): n is a, c, t, g, unknown, or other
  misc_feature (397)..(397): n is a, c, t, g, unknown, or other
aaagctggagctccccgcggtggcggccgctctagaactagtggatcccccgggctgcaggaattcgcacgagaccattacctagaacatcctaatcgaaaaacacaaggctaggcacaagcgaaccaaacccatggcgtccgacggcagcggcgtggtgacggtgtacggcagcaacggcgcggagctgctggagccgtccaagcagcccaagtcggcgactttctccgtcagggtggggctggcgcagatgctcccggggcgggtcatcatgggacgtgggacccccggagcagcgcccctcgcggaagaaggccgcccctgccccctgatggcccttgaacgggtccccgccgacatccncccccagggcggcctggcccccatgtcggacccnggcctcatccgcgacatcaagcgcgccgtcaccatcccggtcatggccaaggcccgcatcgggcacttcgtggaggcccagatcctggagggcgtgggcgtccactacgtggacgagagcgagggtctttacccccccgacgacgcgcaccacatcaacaagcacaactttcgcgtccccttcgtctgcgggtgccgcgaccttcgggaagcgcctccgcagggtgcgcgagggcccccccattatccccaaccaggggggaggccgcacgggcaac

SEQ ID NO: 39479 - protein, 180 aa, Zea mays
  misc_feature: Ceres CLONE 1429640-F
  misc_feature (29)..(180): Pfam Name: SOR_SNZ Pfam Description: SOR/SNZ family
  misc_feature (77)..(77): Xaa is any aa, unknown, or other
MASDGSGVVTVYGSNGAELLEPSKQPKSATFSVRVGLAQMLPGRVIMGRGTPGAAPLAEEGRPCPLMALERVPADIXPQGGLAPMSDPGLIRDIKRAVTIPVMAKARIGHFVEAQILEGVGVHYVDESEGLYPPDDAHHINKHNFRVPFVCGCRDLREAPPQGARGPPHYPQPGGRPHGQ

SEQ ID NO: 39480 - DNA, 715 bp, Zea mays
  misc_feature: Ceres CLONE 1429641-F
  misc_feature (19)..(19): n is a, c, t, g, unknown, or other
gggggtgggggaagggggnttgatggccggcggggggggggggaggcgcgcctcaaagtgggactccccgcggtggcggccgctctgtactagtggatcccccgggctgcaggaattcgcacgagaccattacctagaacatcctaatcgaaaaaactgctccgtcctccaccccgcgcgagtcctccacgcttcgtcatgaggcggctcggcggcgggggcggcgctggcaggggctcggcaacgagccggagcccagggcggagggcggccgcagcaccgtcaagggcggcccccacggcaccgtcaggctgtctccccgggcccggaggaggcgggcgcccggagggtcggcatggcatggcgtgccccaccgcagagggcggacggaccgacacgcccgccgcggggtgacaagcgctccgctgcgcgggcgcccgcgcggacccaaggtggtggtggggacagcacacctggccgcggatgggcgtggacacggcgggaaccggggccaacaaggaagtagcatgcggggtgggggatctccaccgcggcatactgcaaagaattccgccataccaggcaagcccagggcgaaggggcccgggactagcaaaagtgtacggcccaagggcgagccggatgggccaagaagggtatgcgcagggcctgcaacgcaggagggtccccccttccaggaggggcaaagggtctc

SEQ ID NO: 39481 - DNA, 638 bp, Zea mays
  misc_feature: Ceres CLONE 1429642-F
  misc_feature (209)..(209): n is a, c, t, g, unknown, or other
  misc_feature (265)..(265): n is a, c, t, g, unknown, or other
  misc_feature (637)..(637): n is a, c, t, g, unknown, or other
  misc_feature (638)..(638): n is a, c, t, g, unknown, or other
aagctggagctccccgcggtggcggccgctctagactagtggatcccccgggctgcaggaattcgcacgagaccattacctagaacatcctaatcgaaaaagagcagagctgcctccagacgagacgaggaggacgcggcgccgctcgggctttgcagcaacagcgtcgagcgcatgcccttctgtctctatctccccgctgccagccngggtctccttttcagtctccgaagactctgagtttcggtcggaccccttcccccgnaagctgtgttttggtttgaggggaggtaacttcaagggaaccccgaggggccaggaaatgaagccaatttcccaagaaaaaattttttttgttggccctgttttttcggggggggccccctccccccggcttgggggcccgggggggggatggcccccccccatggggtttttttaaccccccccaggggggggtttttaaaaaccgcgccgtggggggggggggcccccccccccccgtgggggggaaaaacggcgcgggttttaatttttttttggggccccccccggggggggtttttctttttttttcccgggggcgcccccagaagggggggggaaatatttttttttgggggggggggggggtggnn

SEQ ID NO: 39482 - DNA, 655 bp, Zea mays
  misc_feature: Ceres CLONE 1429647-F
  misc_feature: Translation starting site: 233
  misc_feature: SWISSPROT Homolog: EC 1.15.1.1 Superoxide dismutase
aaagctggagctccccgcggtggcggccgctctagaactagtggatcccccgggctgcaggaattcgcacgagaccattacctagaacatcctaatcgaaaaatcctcgcttcaggtctgcagcccccaactacccccagcctcggaaggaaccttccagaagcgcaagactctaaggccgtcaccttcccattcttcctcgccgcgggggtcgcctgagatcacataaacaatggtgaaggctgttgctgtgcttggtagcagtgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggtgtttattcttcttttactttggcttgcttatgtgatcagggtgtgtgctaagttaatattggccattgaactttctacttgttggtgaaatcaaggaccacactacaatcctgcgagcaaggagcatggggcaccagaagatgagaaccgccatgccggtgatcttgggaatgtgacagctggagcagatggtgttgctaatatcaatgtcactgacagccagatcccactgactgggccaac

SEQ ID NO: 39483 - DNA, 733 bp, Zea mays
  misc_feature: Ceres CLONE 1429649-F
  misc_feature: Encodes the peptide sequence at SEQ ID NO. 39484
  misc_feature (700)..(700): n is a, c, t, g, unknown, or other
aagctggagctccccgcggtggcggccgctctagaactagtggatcccccgggctgcaggaattcgcacgagaccattacctagaacatcctaatcgaaaactttttccccgctctgctctgcacgcccctctcctccctagtccctccccctacccccgcccgtcaaagcgagagcgccgtatcacctgtctctccgtccaccgccgtctcgatccgcgcccaaagatacctttcccccaccccttcctcgcgccgccgttttggtgcgaccatgacggcggagggggaggccaagaacccgtcggccggtggcggaggggataacccccagcaccagcaggctgcgccggcgccggcgccggcacagggggaagtggcgcaggaggctgcagtgcaggggacgggacaagagcaggagcgggacaaggcggatcgagaggtgcagggcggcgcgggggagaaggacaacggcgcgtgcagagatctggtcctggtcgaggatccggaagtcctcgccgtcgaggatccggaagaagctgcagcaaccgcagcactccaggaagaaatgaaagcgcctgtggcatcaatcccctgatggtgcctggagcagcattccacagccatgccagtttcaggagctaaagcagcaattccccgggggtacccagaacatgggctggcccgaagtaccttgttgnctaactcaacctcggtcctcccgcgggtacgga

SEQ ID NO: 39484 - protein, 107 aa, Zea mays
  misc_feature: Ceres CLONE 1429649-F
MTAEGEAKNPSAGGGGDNPQHQQAAPAPAPAQGEVAQEAAVQGTGQEQERDKADREVQGGAGEKDNGACRDLVLVEDPEVLAVEDPEEAAATAALQEEMKAPVASIP

SEQ ID NO: 39485 - DNA, 664 bp, Zea mays
  misc_feature: Ceres CLONE 1429650-F
  misc_feature: Translation starting site: 199
  misc_feature (115)..(115): n is a, c, t, g, unknown, or other
  misc_feature (642)..(642): n is a, c, t, g, unknown, or other
  misc_feature (664)..(664): n is a, c, t, g, unknown, or other
aagctggagctccccgcggtggcggccgctctagaactagtggatcccccgggctgcaggaattcgcacgagaccattacctagaacatcctaatcgaaaaacaagaggtggccngccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcacgcgggtccgtcgatgtcaccaactcctacgccgtgccgtttgaggaggatgacaaggaatctaggatcttggttccttgaccacaattaccacgagtcaatgtctctcctggttcaagaaggataaatgcccaaggggcatggttattagcatgggcacctgtctcgccacggagatcatcaaattgggcatgttgagcattacttcaggggcaaatccagtgtccgttaagagggcattgataagactgttcagaaattggtggaggaacttgagaagaatcaaggccnggtcagggtagtggggatatan

SEQ ID NO: 39486 - DNA, 728 bp, Zea mays
  misc_feature: Ceres CLONE 1429652-F
  misc_feature: Translation starting site: 238
  misc_feature (711)..(711): n is a, c, t, g, unknown, or other
aagctggagctccccgcggtggcggccgctctagaactagtggatcccccgggctgcaggaattcgcacgagaccattacctagaacatcctaatcggaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggctcccgccccaaccgcgccgccgggtcgggctactggaaggccacgggcgcggacaagcccgtggagcacgggggccggacggcggggatcagaaagcgctcgtgttcaacacggcaagccgccgcgcggggtcaagaccgagtggatcatgcacgagtaccgcctcggcgggcagccaaagaagtccggcgccggcacgctcangctggatgactgggtgc

SEQ ID NO: 39487 - DNA, 671 bp, Zea mays
  misc_feature: Ceres CLONE 1429656-F
aagctggagctccccgcggtggcggccgctctagaatagtggatcccccgggctgcaggaattcgcacgagaccattacctagaacatcctaatcgaaaaaatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgggtacatgtgacgatgcacttaaacttctctgcagtgctttcggatgtcaaatagaagagataacattaccagagcttgaagagatgcgtactgctcatgttgtctcaattggctcagaatcattctgtgacttgaatcctcattacaaagcaggaagaaaaactgagtttaccttggatactcgaacaagtttggcactttttgggtctttcactgcaactgattatgtggcttctcaaagtataaggaggaggataatgcattatcacatggaagcttttcagaaagtcaatgtcatagcaactcctacaactggcattactgctccaaaaatacctcaagtgctctgaagtcaggagagtcagattatgttgt

SEQ ID NO: 39488 - DNA, 586 bp, Zea mays
  misc_feature: Ceres CLONE 1429659-F
  misc_feature: Encodes the peptide sequence at SEQ ID NO. 39489
  misc_feature (224)..(224): n is a, c, t, g, unknown, or other
  misc_feature (225)..(225): n is a, c, t, g, unknown, or other
tccccgcggtggcggccgctctagaactagtggatcccccgggctgcaggaattcgcacgagaccattacctagaacatcctaatcgaaaaatcatcgtggcttgactgcagtctgcagggggtgtggccgcgctgcagcctgcctgtcaatctcgatcgatcaaggggtggcgtgccgagatggcggaccggccgtcgcttcctgctctcattattgctatcnngccgttcttgctggcagttactgccgcgtggcgagctcggcctcgccggcggtggaagatgagctgcgcggtggaggaggagccggccgtccgacgacgatgcggcggcgcgcggcgtcggtgatggtgcccatcaccatcctcaagtccgctgttagcgaccgagctgtgtgcatgaatggaacgccacctgcttaccacttggatcctggcctccggaaccggcaagcaaaagctggaattgggaaatttaaagggagggggcgtggtggcaacaagccgcccaaaaaattgcccgggtccccccaggaaatcctcccggccccggggcttcctgccggaacccccattggaaaacaaa

SEQ ID NO: 39489 - protein, 87 aa, Zea mays
  misc_feature: Ceres CLONE 1429659-F
MRRRAASVMVPITILKSAVSDRAVCMNGTPPAYHLDPGLRNRQAKAGIGKFKGRGRGGNKPPKKLPGSPQEILPAPGLPAGTPIGKQ

SEQ ID NO: 39490 - DNA, 666 bp, Zea mays
  misc_feature: Ceres CLONE 1429661-F
  misc_feature: Encodes the peptide sequence at SEQ ID NO. 39491
  misc_feature (1)..(1): n is a, c, t, g, unknown, or other
nggaattcgcacgagaccattacctagaacatcctaatcgaaaaatcaaccatattattgagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaaagtagctctggcaaacctttctccctactctcagcaacaacaatttcttccattcaaccacctgtcttacactgaaacctgcttgcttatttgccagcaacaacctattaccattttagcccgcttagctaccgccctacttttcaaaaaacaacaacctcttttcccatttaaaccaatttggcccgcacttgaaacccccccttgttttatttttccggcagaaaaaatactaacta

SEQ ID NO: 39491 - protein, 129 aa, Zea mays
  misc_feature: Ceres CLONE 1429661-F
METKIFSLLMLLALSTCVANATIFPQCSQAPIASLFPPYLPSIIASVCENPALQPYRLQQAIAASNIPLSPLLCQQSPALSLVQSLVQTIRAQQLQQLVLPVINQSSSGKPFSLLSATTISSIQPPVLH

SEQ ID NO: 39492 - DNA, 728 bp, Zea mays
  misc_feature: Ceres CLONE 1429664-F
  misc_feature: Encodes the peptide sequence at SEQ ID NO. 39493
  misc_feature (726)..(726): n is a, c, t, g, unknown, or other
aagctggagctccccgcggtggcggccgctctagaactagtggatcccccgggctgcaggaattcgcacgagaccattacctagaacatcctaatcgaaaaatacatttcgactctcaactcccaaggtcccttttttttctcgatctggaagcgccgcagtagcagccatggacgtgagcggagcaggcgggaaggcgaagaagggcgcggcggggcgcaaggccggcgggccgacgaagaagtcggtgtcgcggtccgccagggccgggctgcagttccccgtcagccgcgtcgggcggtacctcaaaaagggccggtacgcgcagcgtgtaggcacgggtgcccccgtctacctcgccgccgtcctggagtacctcgcgggccgagtgctcgagctcgccggcaaacgcgcaagggacaaatagaagacgcgcatcatcccgcggccacgtgctcctcgccatccgccaacgaccaggaacctcggtaagctgggtgggcggggttccacatcgcccaggggggggtccttcccaaaaatccaacttggggttcctccccaaaaagggggccaaaaaggggcccaagagcccaaaaaaggcccccaagcccccccaaaaggggaaaaagtgtctctcctgctttaaaaaaatttccccttttcaaccccggccggtttaaaaaaaaacatgtgtttggggggaaccccccccgggggtttttntt

SEQ ID NO: 39493 - protein, 85 aa, Zea mays
  misc_feature: Ceres CLONE 1429664-F
  misc_feature (29)..(86): Pfam Name: Histone Pfam Description: Core histone H2A/H2B/H3/H4
MDVSGAGGKAKKGAAGRKAGGPTKKSVSRSARAGLQFPVSRVGRYLKKGRYAQRVGTGAPVYLAAVLEYLAGRVLELAGKRARDK

SEQ ID NO: 39494 - DNA, 828 bp, Zea mays
  misc_feature: Ceres CLONE 1429665-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (16)..(16): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (561)..(561): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (595)..(595): n is a, c, t, g, unknown, or other
  misc_feature (615)..(615): n is a, c, t, g, unknown, or other
  misc_feature (648)..(648): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
nnnncccccccccccnccccccccccccccnnccnnnnnnnnnnnngccctttcccccaaactggagctccccgcggtggcggccgctctagactagtggatcccccgggctgcaggaattcgcacgagaccattacctagaacatcctaatcgaaaaacggaagtttcggcggcgccggcgtgctcgtgatctcaacccaaggcgtgcctccgctccggtcacccgtcgctccacgcaaccatgtcgaggaggtaagtaacccaggggtagccccccaaagggaaggcagaaaacgtcaccccctttggaacccactgttccgtggaaggagaagtatggcttttgggggccccctccaaatttttggaacccgcccaagagggacccccccttctttttgatccccactccccggtctctccgacgtggaggggggggagaaaaaaaatacatttgtgtgggttgattggtacccacacgtagatatatttagagggctgtcaaactatagacaggcgattttcctctccctgtaaagaatggtgggccctcccccccnccnnntaggcgcccccgggtatgcaaagggggcntgtagagagggggggggggncacactatcccggcggtggggagggggagcttntctcctgccccgcggtcggatggatttgttggtagcgggggggnnnnaagttatgacgggcagcccaacctacccccggctccaatattttttttttcaccctcctcccgcggcgccgatgggtatgaaatttgagggtctctaaacctttttatttttatcttgtgttttttgcaccca

SEQ ID NO: 39495 - DNA, 677 bp, Zea mays
  misc_feature: Ceres CLONE 1429666-F
  misc_feature: Encodes the peptide sequence at SEQ ID NO. 39496
  misc_feature (402)..(402): n is a, c, t, g, unknown, or other
  misc_feature (403)..(403): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacatcctaatcgaaaaaaaaaaccctaatcgcatctgcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggctacattggcgagttcgagtacgtggatgaccacagagctgggaagatcgtggtggagctgaatggaagactgaanntaatgtgtgttattagcccacgttttgatgtaggtgttaaggagatcgagggatggacggncgagcttcttccatctcgccagtttggctacatcgtcctaacaacttctgctggaattatgaccatgaggaggccccgccgtaagaatgttggtggcaaggttctaggttttcttttatgaaaatgtgtttttttgagccacagatgcgtccaagaactcgtctgatgttttgaggtttgttaagactgggtgtcccagccttttgtgtttgt

SEQ ID NO: 39496 - protein, 130 aa, Zea mays
  misc_feature: Ceres CLONE 1429666-F
  misc_feature (5)..(130): Pfam Name: Ribosomal_S8 Pfam Description: Ribosomal protein S8
  misc_feature (70)..(70): Xaa is any aa, unknown, or other
  misc_feature (71)..(71): Xaa is any aa, unknown, or other
  misc_feature (91)..(91): Xaa is any aa, unknown, or other
MVRVSVLNDALKSMYNAEKIGKRQVMIRPSSKVIIKFLTVMQRHGYIGEFEYVDDHRAGKIVVELNGRLXXMCVISPRFDVGVKEIEGWTXELLPSRQFGYIVLTTSAGIMTMRRPRRKNVGGKVLGFLL

SEQ ID NO: 39497 - DNA, 676 bp, Zea mays
  misc_feature: Ceres CLONE 1429668-F
  misc_feature: Translation starting site: 164
  misc_feature: SWISSPROT Homolog: EC 3.1.3.7 3'(2'),5'-bisphosphate nucleotidase
aagctggagctccccgcggtggcggccgctctagaactagtggatcccccgggctgcaggaattcgcacgagaccattacctagaacatcctaatcgaaaaacgcctcctcctccgcctcccgctcctgccgcgcgtcgccgcgttttgtcgcagtccgcgccatggcttcggggaacccctacgccgccgagctcgccgccgccaagaaggccgtcaccctcgccgccaaactctgccagacagttcaacaggatattatgcattctggcgttcaggctaaggcagacaaaagtcctgtcacagtggctgattatggatctcaaatattggtcggtttttccttaaagatggatgtatcatctggaccattttcattggtggctgaagaggactcagatgaattgagaaaagatggcgctgaagaaatttttggaagatattactgaccttgtcaatgaaaccatctttgatgatgggtcatataacatttcgtttacaagggaagtatactctctgcaattgatgatgggaagtctgagggaagtccatctggacgacatggggtgcttaatcggattgacggtactaaaaggttccttgagggggcgacaatatgccattgcattggctctgcttgatgaaggaaaagttgttttggggtgtatggccttgcc

SEQ ID NO: 39498 - DNA, 710 bp, Zea mays
  misc_feature: Ceres CLONE 1429672-F
  misc_feature (429)..(429): n is a, c, t, g, unknown, or other
  misc_feature (487)..(487): n is a, c, t, g, unknown, or other
  misc_feature (507)..(507): n is a, c, t, g, unknown, or other
  misc_feature (519)..(519): n is a, c, t, g, unknown, or other
aaagctggagctccccgcggtggcggccgctctagaactagtggatcccccgggctgcaggaattcgcacgagaccattacctagaacatcctaatcgaaaaacgcgaccactctgatacaggtcaccagcggtgggccccactacccagacgggtcctggttcctccccctccaagccggctctgaaatttgaggcccatagccccgtcggcccccatcgccacgccgccggccacgccccagacgaccccgcccgccgccgccgcctcccgctccctccgcgcgcagccctcgtccggccgcccgggtccgagcccgctcgttcctcctccccacgttggacagtttaagtgtggcttcattgcatgagtagttgcagttagcgtggcttttctccgtgcttgctcctggtcgtgctttgccttgcnaaggaaagaatcatgacatctgtttgtcacagtgtttcaggtgaccacggggctgaangatcaaaatcacagaagaangcagctgaaccntggggacccagcagaagccccagttactagttcagatagccaaccacagtaggcacaccatcaacagattatggttgcaccttatgcccctcatgacatgagccatgccaatgggtcaaatccgcttatcaaattttgacccctactattggaggctttatgcagcaccttacgggggacagccattgatg

SEQ ID NO: 39499 - DNA, 674 bp, Zea mays
  misc_feature: Ceres CLONE 1429676-F
  misc_feature: Encodes the peptide sequence at SEQ ID NO. 39500
  misc_feature (541)..(541): n is a, c, t, g, unknown, or other
  misc_feature (584)..(584): n is a, c, t, g, unknown, or other
  misc_feature (628)..(628): n is a, c, t, g, unknown, or other
  misc_feature (631)..(631): n is a, c, t, g, unknown, or other
aagctggagctccccgcggtggcggccgctctagaactagtggatcccccgggctgcaggaattcgcacgagaccattacctagaacatcctaatcgaaaacttcccttctgtcgctgctcccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataangaatatgagggggcatgtgaggccactggtgaggatttctctngtgagccagctgatgagaggagcctttccgtgctctcttggatngtngccttataggactacgactgggaaccgtgtcttttgtgcctca

SEQ ID NO: 39500 - protein, 150 aa, Zea mays
  misc_feature: Ceres CLONE 1429676-F
  misc_feature (27)..(143): Pfam Name: Ribosomal_L18p Pfam Description: Ribosomal L18p/L5e family
  misc_feature (118)..(118): Xaa is any aa, unknown, or other
  misc_feature (133)..(133): Xaa is any aa, unknown, or other
  misc_feature (147)..(147): Xaa is any aa, unknown, or other
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDXEYEGACEATGEDFSXEPADERSLSVLSWXVAL

SEQ ID NO: 39501 - DNA, 629 bp, Zea mays
  misc_feature: Ceres CLONE 1429678-F
  misc_feature: Translation starting site: 194
  misc_feature: Pfam Name: PLAC8 Pfam Description: PLAC8 family
  misc_feature (391)..(391): n is a, c, t, g, unknown, or other
  misc_feature (461)..(461): n is a, c, t, g, unknown, or other
ggagctccccgcggtggcggccgctctagaactagtggatcccccgggctgcaggaattcgcacgagaccattacctagaacatcctaatcgaaaagacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggtcgccgcccccgcggacgagaagcccccgcaggctccggcaccggaggccgccaattactatgccgacggggtcccggtcgtgatgggcgagcccgtgtcggcccacgccttcggcggcgtttccgcgggagagctggaactnccggatctctcctgcctcggccgcacgacgagtctgcagcagcgacgtcgaagtgtgtcttctttgaacngtagcaccatgtgtgctctatgggagcaatggtgagaggtttgctgctggacaagggacatttgcaacagctgtttggcttaaccctgggctgtatttgctttgggaactctcccctttggggggaaactgccttgcccccatggtttccttcatcccccttcgtaag

SEQ ID NO: 39502 - DNA, 757 bp, Zea mays
  misc_feature: Ceres CLONE 1429680-F
  misc_feature: Encodes the peptide sequence at SEQ ID NO. 39503
  misc_feature (530)..(530): n is a, c, t, g, unknown, or other
  misc_feature (584)..(584): n is a, c, t, g, unknown, or other
  misc_feature (688)..(688): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (725)..(725): n is a, c, t, g, unknown, or other
aagctggagctccccgcggtggcggccgctctagaactagtggatcccccgggctgcaggaattcgcacgagaccattacctagaacttcctaatcgaaaactcgaaaccctagcgccggcgcctccacttcgttttcctcactctctcctccagctcagggtccggcggcgaagggaaggcaagatgtacaccgcgaggaagaagatccagaaggagaagggccttgagccctccgagttcgaggactccgttgcccaggctttctttgatctggagaacgggaaccaggagctcaagagcgacctcaaggacctgtacatcaacaatgctatccagatggatgttaccgggagcaggaaggctgttgtcatccacgtcccataccgcctgcgcaaggccttcaggaagatccatgtcaaactcgtcagggagctggagaagaaattcagcggcaaggatgtggtaattgttgcaaccaggaggattgtgaggccaccaaagaagggttcagctgttctgccccctcgnacagggactctgaccgccgtccacgaagggatcctggaggatggtgcctacccngtttaaaattgtggggaaaccttgtcaaaatcccccctggatggtcccaagaatatccaagattttcttgggacccccagggagcaggaccccctcttgtattntnnncctggagaacctggccccgccgggtttacctgnagggttttgttgtaaacacacttggccccccg

SEQ ID NO: 39503 - protein, 134 aa, Zea mays
  misc_feature: Ceres CLONE 1429680-F
  misc_feature (6)..(135): Pfam Name: Ribosomal_S7e Pfam Description: Ribosomal protein S7e
MYTARKKIQKEKGLEPSEFEDSVAQAFFDLENGNQELKSDLKDLYINNAIQMDVTGSRKAVVIHVPYRLRKAFRKIHVKLVRELEKKFSGKDVVIVATRRIVRPPKKGSAVLPPRTGTLTAVHEGILEDGAYPV

SEQ ID NO: 39504 - DNA, 728 bp, Zea mays
  misc_feature: Ceres CLONE 1429690-F
  misc_feature: Encodes the peptide sequence at SEQ ID NO. 39505
aaagctggagctccccgcggtggcggccgctctagaactagtggatcccccgggctgcaggaattcgcacgagaccattacctagaacatcctaatcgaaaacattaactagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctaccgtggtggtggcggcggctacggcggtggcaaccgtggcggcggctacggcaactccgacgggaactggaggaactgagcggtggggcccgcgcggccaagttatcctgt

SEQ ID NO: 39505 - protein, 155 aa, Zea mays
  misc_feature: Ceres CLONE 1429690-F
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYRGGGGGYGGGNRGGGYGNSDGNWRN

SEQ ID NO: 39506 - DNA, 713 bp, Zea mays
  misc_feature: Ceres CLONE 1429692-F
  misc_feature: Encodes the peptide sequence at SEQ ID NO. 39507
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgcgccgctctcggtcatgaaattggtgatccagacaaagagn

SEQ ID NO: 39507 - protein, 160 aa, Zea mays; identical to SEQ ID NO: 39381
  misc_feature: Ceres CLONE 1429692-F
  misc_feature (9)..(98): Pfam Name: MtN3_slv Pfam Description: MtN3/saliva family

SEQ ID NO: 39508 - DNA, 784 bp, Zea mays
  misc_feature: Ceres CLONE 1429693-F
  misc_feature: Translation starting site: 229
  misc_feature: Pfam Name: zf-CW Pfam Description: CW-type Zinc Finger
  misc_feature (14)..(14): n is a, c, t, g, unknown, or other
ctctctgtgttgtntctttattttattttgtccatgctccactcccaatcagggtgttcccgcggtggcggccgctctataactagtggatcccccgggctgcaggaattcgcacgagaccattacctataacatcctaatcgaaaaccaatcccatcctccacccaatcgaaggacctagcgagcggcagcggcggcggcgatcggagaagatggtgcgcaaggcgaatgttgagttcgacgagcagccaccggataacttcgacccaaagaacccgtatgccgacccggtcgttgcaatgctataagtgctacaaatggagtacggttccaaaagaagaatttgagacgcttcgtgaaaacttcactaaggatccatggttctgcagcagacgaccagacagctcttgtgaagacgatgctgaggttgagtacgacagcagccgcatttgggttttggacaagcccaacataccaaagcctccaccagagacggagaggctagtggttatgagggggcgactacagcaaaatggacacatattatgtcatgcccaatgggaagcgtgcaaggggtgctggtgatgtggataagtttctggaggcaaatccggagtacaaagaccgcatatctgcttcggatttcacctttgcgccacccaaaggttgttgaggagactgtttctccacaaccctgcctgggcagcttgccaaggcccaagaaagcaggaagaaggcagaaagcccccaaaaatggaatggatacttcccaaacggtggcttg

SEQ ID NO: 39509 - DNA, 609 bp, Zea mays
  misc_feature: Ceres CLONE 1429694-F
  misc_feature: Encodes the peptide sequence at SEQ ID NO. 39510
aaagctggagctccccgcggtggcggccgctctagaactagtggatcccccgggctgcaggaattcgcacgagaccattacctagaacatcctaatcgaaaagacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggtcgccgcccccgcggacgagaagcccccgcaggctccggcaccggaggccgccaattactatgccgacggggtcccggtcgtgatgggcgagcccgtgtcggcccacgccttcggcggcgttccgcgggagagctgggactccgggatcctctcctgccctcggcgcaacgacgagttctgcagcagcgacgtcaaagtgtgtcttctggaaacggtacaccatgtgtgctctatggtacaatgttaagaggcttgctgctggaacaggcacttttccaaaccggttttttgcttaacactgggctgtttttgcttgggaactcttctttgggggggaaccgccttgcccccggg

SEQ ID NO: 39510 - protein, 100 aa, Zea mays
  misc_feature: Ceres CLONE 1429694-F
MGAGANNHEESSPLIPAAVAAPADEKPPQAPAPEAANYYADGVPVVMGEPVSAHAFGGVPRESWDSGILSCPRRNDEFCSSDVKVCLLETVHHVCSMVQC

SEQ ID NO: 39511 - DNA, 666 bp, Zea mays
  misc_feature: Ceres CLONE 1429700-F
  misc_feature (443)..(443): n is a, c, t, g, unknown, or other
  misc_feature (503)..(503): n is a, c, t, g, unknown, or other
  misc_feature (504)..(504): n is a, c, t, g, unknown, or other
aagctggagctccccgcggtggcggccgctctagaactagtggatcccccgggctgcaggaattcgcacgagaccattacctagaacatcctaatcgaaaaaattccacactctctctctccatcaattccttgcttgattgcttggcatggttgcgcggtcaatgtccaacccgtccccaattcgaatcctcttcttcctctgtgctgctgctgctcacagacccaggccaagtcgtctcagtcctcttctaccaccaagctcccgtctcttcccctcctggtctcagcgactccatcctctccctctccagatccccgcccgtgacgccgccggctgttacctctccggctcatcgtcctcaggcccaggtaattcatcagttgccgtgcttttatcgtttccctaccgatttacggtacagtacttgctccactccgtcngccgtgctgctgcgggcagtgattgattcgtcggccaaaggaccgtctttttttctccanntcatcatccatccatccatccatccttatgagcgattctagcttcttggattaaatcaattgggcggatgaccaccgtgcctcccgaatttgcaggtcttgatccgcgatcggccaatttccatccgggcttactcggggtcccgtcacctgcgggttttgg

SEQ ID NO: 39512 - DNA, 692 bp, Zea mays
  misc_feature: Ceres CLONE 1429702-F
  misc_feature: Translation starting site: 186
  misc_feature (223)..(223): n is a, c, t, g, unknown, or other
  misc_feature (230)..(230): n is a, c, t, g, unknown, or other
  misc_feature (237)..(237): n is a, c, t, g, unknown, or other
  misc_feature (239)..(239): n is a, c, t, g, unknown, or other
  misc_feature (241)..(241): n is a, c, t, g, unknown, or other
  misc_feature (249)..(249): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaatcaactcgcaattccgcattcgttccaactcctgagcactttctcctcgtccccgacaagccaatcgaagccgagatacggccatggactccaccggcaccggagcagggggtaagggaangaagggnagcgccngncncaaggtcngcgggccaagaaagagtcggtgtcgaggtccgtgaagggcgggctccagttccccgtcggccgcatcgggcgctacttgaagaagggccgctacgcgcagggtgtcggcaccggcgcccccgtctacgtgggcggtgtcctcnaatacctccgccgctgaggtactgccattttgaggccagttcttttgttttgtactgattttggcaacggagttttaaattcttgccgtcccgaatcgtttttgcttccttgtttgaaccaggttctggaacccccccgggattgtttcccgggaacacaaagaaaactccctattattccccgcccacgtgtttttggcaatccgaaaccaacaaagaactttgggaaaatttttggggcggctttaactatcccctcaggggggtgtgccccccaaatatcaacccttgtttctgtac

SEQ ID NO: 39513 - DNA, 715 bp, Zea mays
  misc_feature: Ceres CLONE 1429703-F
  misc_feature: Encodes the peptide sequence at SEQ ID NO. 39514
  misc_feature (503)..(503): n is a, c, t, g, unknown, or other
agctccccgcggtggcggccgctctagtactagtggatcccccgggctgcaggaattcgcacgagaccattacctagaacatcctaatcgaaaagaacaagagcaaagccctgaaatccttctccccctgcacgcacctgcagacctgctctctcgcgcgcatctcccgtgcccctcactgtttagtggcgacgactgggcgacagtcgccgccgccgcccgctaggggccgtgcccctggtctccatcttcgggcgcttcgcccaccagatatgagcagctggcaattcgattttgaggccattatttgataacccgggacaagtgcactgttacctgaccattttagcttgttcagatggctacacagttgccatgcttcacacagctcagtccaccgtcttgtagttggataaaagatgtcgggaactgcaaggctacgcctgatagggtagccagaagtgcccgagctttgggccactgtcacttccggtgctgtgcangccccccgtagtgcaaactcttttcagaagaaagactctttcgagaaaaagactctttcctcgaacttcatccggaagtatctcctgctccgtggcaagaagagtgccgaggttgtgcccatgaaaggttcctcttgattggggtctgttagagggactgggggtggccgccggaccaaaatgattaccgtgaggctaaaatcagggtagtt

SEQ ID NO: 39514 - protein, 51 aa, Zea mays
  misc_feature: Ceres CLONE 1429703-F
  misc_feature (49)..(49): Xaa is any aa, unknown, or other
MATQLPCFTQLSPPSCSWIKDVGNCKATPDRVARSARALGHCHFRCCAXPP

SEQ ID NO: 39515 - DNA, 716 bp, Zea mays
  misc_feature: Ceres CLONE 1429709-F
  misc_feature (1)..(1): n is a, c, t, g, unknown, or other
  misc_feature (19)..(19): n is a, c, t, g, unknown, or other
  misc_feature (53)..(53): n is a, c, t, g, unknown, or other
  misc_feature (55)..(55): n is a, c, t, g, unknown, or other
ngggggaggagggagaggnggccggaaggacaggggctgcgcgggcacaggcntnttttggggtttacaaactggagctccaccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcagggggtgctaggctaggctgagcgtcgtgacgacggaaaaaatgggcccagaaaggggggaagggaaacattgggtgggggcgccccgctgcccttgggggggacaggaggggcccctaaggggatagtagtggggggaaataaaataaagggggtaaaggaaggggctatattggtggaacaaaaggggggaaaaaaggaaaggggaaaaaaggggggggggaaggggaaaaagggaataggagaaatgggagggataaaaggggggaaggggggaaaaaagggggggagggggaaaagggtggggggaaaagcggaaaacagggggaacaagggg

SEQ ID NO: 39516 - DNA, 715 bp, Zea mays
  misc_feature: Ceres CLONE 1429724-F
  misc_feature: Encodes the peptide sequence at SEQ ID NO. 39517
tggagctccccgcggtggcggccgctctagaactagtggatcccccgggctgcaggaattcgcacgagaccattacctagaacatcctaatcgaaaaaaaaatcgaacccaagtcgaaaccctaacctcggccttctcgatgtcggccgccacaaccgacccaacccctgcggtgtgcacccctatagcgccccctccgtccgacccagacatctcccgaaggtgctgcaacagaagatgcaagggggaagaggtgggaggcagggcttattcggtttcggggacccttctggtggttccggtggctttggacaaccagggagccttatgcctggtttttttggtggcgcaaatccctttgacgaccctttcttcacaaacccctttggtagcatgatgcagactagtttctcagcccctttcagcggcatgatgcaacctagcttcatgaaccccttcggcagcatggtgcaacctagcttgcttggaccaagtatgtttgcgccccatggcaatctcaatggaggcatgtttggaagccagacacatctcagtcaaggtatcagcaatggcagtggtttcattcagcagggccctgaaccaagcaggcctaaagggccaattatcaaggagttatcttcagatgatgaggatgatgtagatgatgatgaagaaggccagaagaagaaatgtaaccttaggaagcatcaaaggg

SEQ ID NO: 39517 - protein, 159 aa, Zea mays
  misc_feature: Ceres CLONE 1429724-F
MQGGRGGRQGLFGFGDPSGGSGGFGQPGSLMPGFFGGANPFDDPFFTNPFGSMMQTSFSAPFSGMMQPSFMNPFGSMVQPSLLGPSMFAPHGNLNGGMFGSQTHLSQGISNGSGFIQQGPEPSRPKGPIIKELSSDDEDDVDDDEEGQKKKCNLRKHQR

SEQ ID NO: 39518 - DNA, 699 bp, Zea mays
  misc_feature: Ceres CLONE 1429734-F
  misc_feature: Encodes the peptide sequence at SEQ ID NO. 39519
  misc_feature (527)..(527): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctccacgtcnggcgcgctgggggctcggggggcctgtccctcgctccacgtggcctccgccaaaacgggggcgggaaggggtttccaagcgcaaccccccggaatataaccgggaaggggagggccccccccccccccaaatattgttgtaaagccgccgcgcccccccccccctgcccccc

SEQ ID NO: 39519 - protein, 164 aa, Zea mays
  misc_feature: Ceres CLONE 1429734-F
  misc_feature (44)..(151): Pfam Name: Oleosin Pfam Description: Oleosin
  misc_feature (108)..(108): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLHVXRAGGSGGLSLAPRGLRQNGGGKGFPSATPRNITGKGRAPPPPKYCCKAAAPPPPCP

SEQ ID NO: 39520 - DNA, 672 bp, Zea mays
  misc_feature: Ceres CLONE 1429739-F
  misc_feature: Translation starting site: 466
  misc_feature (586)..(586): n is a, c, t, g, unknown, or other
ggagctccccgcggtggcggccgctctagaactagtggatcccccgggctgcaggaattcgcacgagaccattacctagaacatcctaatcgaaaaatcaccaccactgggtctttagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgaccgcnaccccctactggtcgccttaatggcaatctttttcggccccattggttgccgcccctcgggcggggaccccaaccccgtcccggga

SEQ ID NO: 39521 - DNA, 736 bp, Zea mays
  misc_feature: Ceres CLONE 1429751-F
  misc_feature: Encodes the peptide sequence at SEQ ID NO. 39522
aaagctggagctccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaaacagcgaaagcactagttgaagaactacggaagttgtctaaggaggtcgaagatagtgagcttgcagatg

SEQ ID NO: 39522 - protein, 179 aa, Zea mays
  misc_feature: Ceres CLONE 1429751-F
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELAD

SEQ ID NO: 39523 - DNA, 660 bp, Zea mays
  misc_feature: Ceres CLONE 1429760-F
  misc_feature: Encodes the peptide sequence at SEQ ID NO. 39524
gctctagatctagtggatcccccgggctgcaggaattctcacgagaccattacctagaacatcctaatcgaaaaaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacagggctgagcagctccaagccaagggtggagacgagattcttgcttatcaggttaacgacccctttgttatggaagggttgggccaagacctcccccgagaacaaggacgtggagtttcctcgccgaacggatctgggagcgtaacccaaagggggttagaccctcaaagttgaattcctccgggaaaaaggggtggggcctgcccccccaaaagagggtttccgtttctctgggcgcaaaaaaccccacggggaccccgctctgcaaaacacttcaaagaaaaggggggggcaagttcccccgaaatcccccggccg

SEQ ID NO: 39524 - protein, 63 aa, Zea mays
  misc_feature: Ceres CLONE 1429760-F
  misc_feature: SWISSPROT Homolog: EC 1.11.1.15 Peroxiredoxin
MAPIAVGDALPDGQLGWFDENDQLQQVSVHALAAGKKVILFGVPGAFTPTCSNQHVPGFITQG

SEQ ID NO: 39525 - DNA, 651 bp, Zea mays
  misc_feature: Ceres CLONE 1429762-F
  misc_feature: Translation starting site: 160
  misc_feature (651)..(651): n is a, c, t, g, unknown, or other
gctctagtactagtggatcccccgggctgcaggaattcgcacgagaccattacctagaacatcctaatcgaaaaagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacggggcgcacaacggcaagaaggtcatggctgtccgcatcatcaagcatacccctggagatcattcaccctgctcaacgatggccaaccccatcaggtcggcctccaaccaatcatcaacagtgggaacccctggaggaatgcaacccgtattggtttcccctggtgttgggaagaagccaggccctggaaatctcccccccggaggagggggaaccaggcatttaacctcctccacactgggggccgggaaaaggcttttccggaaacan

SEQ ID NO: 39526 - DNA, 716 bp, Zea mays
  misc_feature: Ceres CLONE 1429764-F
  misc_feature: Encodes the peptide sequence at SEQ ID NO. 39527
agagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagctagatggcgtgtccatccctgatgctgcaggaactggtgaccttgcccctgcgaacaaccgcccaagagcccctcctaccccccggtcgtcggccctcccaagggccccgtcacgcgcccgccagtcacgcgtccgccggtcgtcggtcctcccaagggccccgtcacgcgcccgccggtcacgcgtccgccggttgtcggaccaccggtgacctacccgccgatcaccggccctccgacgacgccgcctgttgtcggaacaccggtgacctacccgccgatcaccggcccttcaaaaacgactcctgttgtcgggccaccggtgacctacccaccgatcactgggccgcccgcaacgacgcccccggtcaccggtccgcccgtgacctaccaacccg

SEQ ID NO: 39527 - protein, 52 aa, Zea mays
  misc_feature: Ceres CLONE 1429764-F
MAAKMLALFALLALCASATSATHIPGHLPPVMPLGTMNPCMQYCMMQQGLAS

SEQ ID NO: 39528 - DNA, 713 bp, Zea mays
  misc_feature: Ceres CLONE 1429765-F
  misc_feature: Encodes the peptide sequence at SEQ ID NO. 39529
  misc_feature (496)..(496): n is a, c, t, g, unknown, or other
  misc_feature (541)..(541): n is a, c, t, g, unknown, or other
aaagctggagctccccgcggtggcggccgctctagaactagtggatcccccgggctgcaggaattcgcacgagaccattacctagaacatcctaatcgaaaagaccttccagtcttctccgtaggggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgagaagatgaggctgcaggtgccagggataaaggtatttggaggatccctggacaatgtgaaaggctgcactgatcaggtggagaatggaatgaagttgtcacttngggaggacattgagatactatgcctacacacgcctttgcacactnaaggtcatatcagctactatgttactagtaaggagggtgaagatccagcggtcttcacgcgagataccttgtcattgctggtggggggaagtttttgagggttctgcaaagcaatgtatcagccccttattggtaccctggttcccctgccaggccaacccgagtttacggg

SEQ ID NO: 39529 - protein, 145 aa, Zea mays
  misc_feature: Ceres CLONE 1429765-F
  misc_feature (11)..(143): Pfam Name: Lactamase_B Pfam Description: Metallo-beta-lactamase superfamily
  misc_feature: SWISSPROT Homolog: EC 3.1.2.6 Hydroxyacylglutathione hydrolase
  misc_feature (99)..(99): Xaa is any aa, unknown, or other
  misc_feature (114)..(114): Xaa is any aa, unknown, or other
MKIIPVPCLDDNYAYLIVDESTKKAAAVDPVEPEKVLKAAGEVGAYVDCVLTTHHHWDHAGGNEKMRLQVPGIKVFGGSLDNVKGCTDQVENGMKLSLXEDIEILCLHTPLHTXGHISYYVTSKEGEDPAVFTRDTLSLLVGGSF

SEQ ID NO: 39530 - DNA, 737 bp, Zea mays
  misc_feature: Ceres CLONE 1429766-F
  misc_feature: Encodes the peptide sequence at SEQ ID NO. 39531
  misc_feature (724)..(724): n is a, c, t, g, unknown, or other
aaagctggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattccgaaaacttcacggtcgagaactctgttctgttcgctggtccgttagctancacctcaatcagc

SEQ ID NO: 39531 - protein, 166 aa, Zea mays
  misc_feature: Ceres CLONE 1429766-F
  misc_feature (58)..(166): Pfam Name: PAP_fibrillin Pfam Description: PAP_fibrillin
  misc_feature (162)..(162): Xaa is any aa, unknown, or other
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEISQTIDSENFTVENSVLFAGPLAXTSIS

SEQ ID NO: 39532 - DNA, 767 bp, Zea mays
  misc_feature: Ceres CLONE 1429768-F
  misc_feature: Encodes the peptide sequence at SEQ ID NO. 39533
  misc_feature (767)..(767): n is a, c, t, g, unknown, or other
agaagctggagctccccgcggtggcggccgctctagtactagtggatcccccgggctgcaggaattcgcacgagaccattacctagaacatcctaatcgaaaagtcagatggggaagtacatgcgcaagtgcaggggggccgcaggcgcggaggtcgccgccgtctaggttacgcaggtcgtcggcgtccgcacgaggtccaggtccgcggcggcgaccggcggtgtcgcgaaggtcgtcgccccgaggaggaagagggcgccggcgggggagcctgctgcctccgtgggcgctggtggggacggcggaagctgctacatccacctgcgtagccgcatgctgttcatggcaccgcctcagccgcagccgccgtcggttccgaccgcgggggaggctgctgatggcgctgcaggacagcagggcgcggcgctcgcggccgggctctcgcgttgctccagcacggcgtcatcggtgcacgtggggggtcagcgcgggagccactcctgccgctccgacgacgctgcagatgctgtcggggatcacctccttgttggatgtctcggcggctagcaacttccgggagcgggcccaaaccgctttgaggctgaaagacaactcccatcaaatccgggactcacgtgcgtagcctcaccctactctggaagttccggattctgggtggggtgtaaaaagaatggggcctcttttggcttacttgtgtggtttaagtttccgtccttccgggatgtctgaatttgtgatccacn

SEQ ID NO: 39533 - protein, 77 aa, Zea mays
  misc_feature: Ceres CLONE 1429768-F
  misc_feature: The sequence is a functional homolog of SEQ ID NO 2 in US patent 7256280
MLFMAPPQPQPPSVPTAGEAADGAAGQQGAALAAGLSRCSSTASSVHVGGQRGSHSCRSDDAADAVGDHLLVGCLGG

SEQ ID NO: 39534 - DNA, 806 bp, Zea mays
  misc_feature: Ceres CLONE 1429770-F
ctggctggagctcaccgcggtggcggccgctctagaactagtggatcccccgggctgcaggaattcgcacgagaccattacctagaacatcctaatcgaaaaactccatccattgcacaaagagcgttcctttctgttttctctctcctctcttatttctcttttttttttcctttttttcttttttttttcctttttttcttcctttcggttttttttgtttctctcttcgcgttaggtgattccccacccgacgccaacgaggggaaagagccgtttttcgctggcaacgaagaggacactttggccccccagaagagaggtggactatgaggggtagacgacaggggtcaattgtgttctttgggtgaggagggcagagagggtttggtggcaaccagcaccgcgtctcgtccatgaatccccactttagggggtcctcgctccccctttctggggggggaggccctttaccaaggtggaagaccttgcgcactggggtcccaacgcccaggtgcctgccccgcccgcgctagcgcgaggtgtggaaggggtagggaggggggcgaaccgccgctcccccttcagaagaacgtttggggctggcgcacggcccgtgtagcgaacagagaagtgatattcacgtactgggggcgcacggccggtgttccgggcgggtgtgcgtgggagtcgggtactcaggaggacgggtcgttcggaaccgcgggggtgaatggtgatctggcttgggcgtgcgggcgcccggaagtaggcgcgcggcggggtggcgcctccgctcagcactc

SEQ ID NO: 39535 - DNA, 695 bp, Zea mays
  misc_feature: Ceres CLONE 1429773-F
  misc_feature: Encodes the peptide sequence at SEQ ID NO. 39536
aaagctggagctccccgcggtggcggccgctctagaactagtggatcccccgggctgcaggaattcgcacgagaccattacctagaacatcctaatcaaaagactgtttgttttctaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacggagatccagccggacctgcggtggtcccttccttttctcgatagcataatgagctcgccagtggagaggtgattcgtcaggctggtatcaagttcctagtctatggtgcctggatgagcagtagagatgctactggccgtggaaggaggagggttcttctcgtcttcagctacaggttacagccatggcctcgccctcttgctgctcggacgcaaagctgaggagaagcccgtaaaggtctcgccgtggaaccagtaccggctagtcgaccgggagaccgagcaggtgtaccacctgccctccgcaaggggacagctcctgggaaatgtgctccctttgtctgcttcggatgacgggctaatgccctcgaggtggcgtctcctccaaaagcgaccctcagcatggcctgggtcacggt

SEQ ID NO: 39536 - protein, 97 aa, Zea mays
  misc_feature: Ceres CLONE 1429773-F
MLLAVEGGGFFSSSATGYSHGLALLLLGRKAEEKPVKVSPWNQYRLVDRETEQVYHLPSARGQLLGNVLPLSASDDGLMPSRWRLLQKRPSAWPGSR

SEQ ID NO: 39537 - DNA, 700 bp, Zea mays
  misc_feature: Ceres CLONE 1429798-F
  misc_feature (623)..(623): n is a, c, t, g, unknown, or other
tccccgcggtggcggccgctctagaactcgtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctcccctactctcagcaacaacaatttcttccattcaaccaactgtctacattgaaccgtgctgcttatttgcagcaacaactattaccattcagccagctagctactgcctactctcagcaacaacaacttnctccatttaaccaatggccgcactgaaccccgctgcttatttgccgcagcaatactactaccatttaggcagctagc

SEQ ID NO: 39538 - DNA, 734 bp, Zea mays
  misc_feature: Ceres CLONE 1429803-F
  misc_feature: Encodes the peptide sequence at SEQ ID NO. 39539
  misc_feature (29)..(29): n is a, c, t, g, unknown, or other
agagctggagtccccgcggtggcggccgntctaggatcgtaagaggcgtgggctgcaggaattcttccgagaccaggacctagaacatcctaatcgaaaaacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctggggagatccaatggaatttgtgggaaacaagttgcgtatgccctgtctcagggactaaaggtcattgcatggtgttgggaaaacctttgaccaaaagggaggctgggcctacccaggaaggttggtggcggcccaaaacaaaagcatttgcttaaaaaatcagggattgggagcacctttttttttcccctaaaacccttttggggctattggaaacgggaaaaa

SEQ ID NO: 39539 - protein, 132 aa, Zea mays
  misc_feature: Ceres CLONE 1429803-F
  misc_feature (5)..(132): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGRSNGICGKQVAYALSQGLKVIAWCWENL

SEQ ID NO: 39540 - DNA, 647 bp, Zea mays
  misc_feature: Ceres CLONE 1429813-F
  misc_feature: Encodes the peptide sequence at SEQ ID NO. 39541
  misc_feature (200)..(200): n is a, c, t, g, unknown, or other
  misc_feature (204)..(204): n is a, c, t, g, unknown, or other
  misc_feature (211)..(211): n is a, c, t, g, unknown, or other
  misc_feature (251)..(251): n is a, c, t, g, unknown, or other
  misc_feature (599)..(599): n is a, c, t, g, unknown, or other
aagctggagctccccgcggtggcggccgctctagaactagtggatcccccgggctgcaggaattcgcacgagaccattacctagaacatcctaatcgaaagacagcctcacactcacttgaccgaccctttgcgacgccaaccggccaaagctcccggctcggcggcgccgcttcgtttcgttgatggattggtcacccnggtncgcaccngaaagccgtcggcgggcgtgtcccacttttgcgggcacangcggagtcaagcggatagggtatttctcggaacattgcgtccggcggcccggtggaggaacccaaccgcggcggccaggcaaaagggccgcttaaccggtaaattctttattccgggccaccttaggaacccttgccccgtataaaccatcctgggcctttgaggggttatctgctccccccttggggtaaaccccaagaacttatcccggtggagtgccaatggaaatcctcattgggcccccccccggaggtccccttcaccaccaagggaatctccacattccccccttttgggtcccccgataccccaaaaaaccccccaattgggggggcgggcccctttttnaaaaaattctcgaacgttgaacctcaattacccacggttgggggggag

SEQ ID NO: 39541 - protein, 53 aa, Zea mays
  misc_feature: Ceres CLONE 1429813-F
  misc_feature (6)..(6): Xaa is any aa, unknown, or other
  misc_feature (7)..(7): Xaa is any aa, unknown, or other
  misc_feature (23)..(23): Xaa is any aa, unknown, or other
MDWSPXXAPESRRRACPTFAGTXGVKRIGYFSEHCVRRPGGGTQPRRPGKRAA

SEQ ID NO: 39542 - DNA, 730 bp, Zea mays
  misc_feature: Ceres CLONE 1429815-F
  misc_feature: Encodes the peptide sequence at SEQ ID NO. 39543
atagctggagctccccgcggtggcggccgctctagattagtggatcccccgggctgcaggaattcgcacgagaccattacctagaacatcctaatcgaaaaatatccatcctcggtagttcgcacgctctccttgcaactccagtgaggctcaatgccactgacagaataccgagctgtggggtctacacataccctctcgctttgctgttgctgctgccagtatgccaccgcgtacacacagatgttgacgacggtgagccgtgcgtccctcgaccataaggtcgccctcgccaagccttgctcccgataggctaccctcaccggagccaaagccgctgcagggtcgactatcgcctccgttatacccaccatctccagtttggggacgctagcctgttcaaaagccaacatcagccccacaggacggtccttcatcgtctcgacattggcgggaagggcataattaatcgtggacgacaagacgagcgtgtgcgtggcggagccgccttcgtctaagcagggggctgaggaccacaaggcacctggttcgatgggaccagtggatgagacccaaacgactactggaagcgagacaagacctccgtccctagaatggacgcatgaggtgttataacgctctgcttcccctatcccttggtggccgggggggtccgcctaaagccgactacagctgattcttcacccgggggctcccctcattcacccct

SEQ ID NO: 39543 - protein, 52 aa, Zea mays
  misc_feature: Ceres CLONE 1429815-F
MPLTEYRAVGSTHTLSLCCCCCQYATAYTQMLTTVSRASLDHKVALAKPCSR

SEQ ID NO: 39544 - DNA, 804 bp, Zea mays
  misc_feature: Ceres CLONE 1429816-R
  misc_feature: SWISSPROT Homolog: EC 2.7.1.4 Fructokinase
  misc_feature (702)..(702): n is a, c, t, g, unknown, or other
ccgggccccccctcgaggtcgacggtatcgataagcttttttttttttttttttgcacaaggcattcattgaaaactctgcatggaaggcatcacattagccttccctatcacacgacactagcaatgttcaaaaccccaactgatcctagctaaaaataaaataataataaaggatagcatcccaccacgcatgccaacattttattgatgccccggggcgaaatctccactaaaactaacttatattaaccctaacaaaccgtctcagcgtagaagcgcagagacggacgctaagactccatctaactaatgaaccgaaaccgacgacgtccaccacttagggcggggcggctggggacagtgacttggtggaacggcgggcatgcggccatgatctagtcggccttggcgatgaagtcctgcagcgtggccaccgtgggcagcgcccatatggcgcccttcttggtggcgcagatggcgccgcaagcgttggactacttgagatgctcgcggagcctctcctcgttgtgggaggattggagtcgtccttgggcgacgttgaccaggcaggaagctgacgaaagcgtcgccggctgccagtgggtgtctactgttgccaaactttgaagccggacacacctgcccttggaagcccctgggtggaagtaacctgcatcccctggggccccggcgggggacngaactaactaacttgaagcccgtctaaacccaaggggaaaagcaccgttccttctcaatccgttttggggtcccccgcaaccctgtaagtaaaggcccccct

SEQ ID NO: 39545 - DNA, 736 bp, Zea mays
  misc_feature: Ceres CLONE 1429816-R2
  misc_feature: SWISSPROT Homolog: EC 2.7.1.4 Fructokinase
  misc_feature (540)..(540): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
tcgaggtcgacggtatcgataagcttttttttttttttttttgcacaaggcattcattgaaaactctgcatggaaggcatcacattagccttcccaatcacacgacactagcaatgttcaaaaccccaactgatccaagctaaaaataaaataaaaataaaggatagcatcccaccacgcatgccaacattttattgatgccccggggcgaaatctccacgaaagctaacttaattaacccaaacaaaccgtctcagcgtagaagcgcagagacggacgctaagactcgatctaactaatgaaccgaaaccgaggacgtccacgactaggggcggggccgcgggggacagtgacttggtggaacggcgggcgtgcggccatgatctaaccgcccttagcaatgaggtcctgagcggtggccaccgtgggcagcgccgggatggcgcccttcttggtggtgcatatggcgccgcacgcgttggacaacttgagatcctcgcggagcttctcctcgttgtggaagatggagtcatccttggngacttacagaagacagaaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagnnnnnnnnnnnnnnnnnnnnnnnnnnnnnnnnnnnnnnnnnnnnnnnnnnnnnnnnnnnnnnnnnnnnn

SEQ ID NO: 39546 - DNA, 613 bp, Zea mays
  misc_feature: Ceres CLONE 1429818-F
  misc_feature (229)..(229): n is a, c, t, g, unknown, or other
  misc_feature (245)..(245): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
ctccccgcggtggcggccgctctagaactagtggatcccccgggctgcaggaattcgcacgagaccattacctagaacatcctaatcgaaaaactccgatcctgccctctaataacagcagcagcagccgccatggaaggcagcagcaagaagctccagccgttcctcctcacgctgctgctggtgctctccaccgccgtgacgcccatcctctcgctgtcagtgccangacgacgaggtagccntgcgactgcgacaaacccaaggcgcccaagccgtcgcacccgcccaagaccaagccctcccacccgtcgccgaagcccaagaaccccaagccacccaagggcggcaccgggtacccggcgccaggcaccaaccgcccaagagcccctctacccccggtcgtcgccctccaatggcccgtcacgcgccggcagtcacgcgtccgcggtcgtcggtctccaaaggccccgtcacgcgcccggcggtcacgcgtcccccggttgttcggaccaccggtgacctacccgccgatcaccggcccctcggaaaaaccccccttgttgccggaaccaccggggaaccctacacccccccgggnnnagaaaaaaaa

SEQ ID NO: 39547 - DNA, 759 bp, Zea mays
  misc_feature: Ceres CLONE 1429838-F
  misc_feature: Encodes the peptide sequence at SEQ ID NO. 39548
  misc_feature (653)..(653): n is a, c, t, g, unknown, or other
gctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagactgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccctcctggatctgttgcgcgagatcgcggccgcgcgcgagattcgccccccttccttctcctatgattgtgtgaatgtcccccgaccgctctgcagagctccccccgcccatggccctcttcgcccgccatggaccttctggttgggaggatcacccccgcgcgagtgcctcccgcgcgttttgtcctctatcactcccccttctacagctctggctgacccgcncccccgcccccccaggctcgcgccaggctccaggtacgctccgtcccctctccctctgtgtttcctgggcttcgtatatacacactccgctgcgtacccagctcga

SEQ ID NO: 39548 - protein, 29 aa, Zea mays
  misc_feature: Ceres CLONE 1429838-F
MDLLVGRITPARVPPARFVLYHSPFYSSG

SEQ ID NO: 39549 - DNA, 715 bp, Zea mays
  misc_feature: Ceres CLONE 1429844-F
  misc_feature: Encodes the peptide sequence at SEQ ID NO. 39550
  misc_feature (613)..(613): n is a, c, t, g, unknown, or other
  misc_feature (715)..(715): n is a, c, t, g, unknown, or other
ctccccgcggtggcggccgctctagaactagtggatcccccgggctgcaggaattcgcacgagaccattacctagaacatcctaatcgaaaaaacaccaccgctcgactgctctcaccgaccagcgctgcgccactcctccgccggatctccagcatgcagccctcctcctcgtcctcctccgctcacccgcccgaccatcccaactccaagcccccggccccgccggcccccgccatgggctaccccgccaaccccgcccccaacgggaaccccagcgcctacttcgccgccgcgccgcccgccgccgccgccgccaacggctccgctccggcgtccttcggcgtcgcctacccctaccccgcccctcctcaccaccatcacccgccgccgcaccaccactacccgtaccccccgcccccgccgacgcaccaccactacgcggcccacccgccgccgccgcccacctgcctgcgccgcctcctcgccgccgtcgttggcgccttccttctcctcggcgccgccaccttcatagtctggctcctcctccgcccgcgcgccccggccttctccctcacctccctggccctctcccgcgtcgcttactcccccgncaactcctcactctccgcctccttcgacgctgccctcctcgccgccaacccaacgccaagctctccgtcgcctacttctcacccctcgcatccgtctccttn

SEQ ID NO: 39550 - protein, 186 aa, Zea mays
  misc_feature: Ceres CLONE 1429844-F
  misc_feature (153)..(153): Xaa is any aa, unknown, or other
MQPSSSSSSAHPPDHPNSKPPAPPAPAMGYPANPAPNGNPSAYFAAAPPAAAAANGSAPASFGVAYPYPAPPHHHHPPPHHHYPYPPPPPTHHHYAAHPPPPPTCLRRLLAAVVGAFLLLGAATFIVWLLLRPRAPAFSLTSLALSRVAYSPXNSSLSASFDAALLAANPTPSSPSPTSHPSHPSP

SEQ ID NO: 39551 - DNA, 824 bp, Zea mays
  misc_feature: Ceres CLONE 1429847-F
  misc_feature: Encodes the peptide sequence at SEQ ID NO. 39552
  misc_feature (22)..(22): n is a, c, t, g, unknown, or other
  misc_feature (47)..(47): n is a, c, t, g, unknown, or other
  misc_feature (667)..(667): n is a, c, t, g, unknown, or other
gttgggtgtttggagggggtanaataggggaaaggaaagggccgccnccccaaactggagctccccgcggtggcggccgctctagaactagtggatcccccgggctgcaggaattcggacgagaccattacctagaacatcctaatcgaaaaaccaaggaaattcacaaagagatactagtccctaccaaagcatacttcctgaaacactcttgcaatccactgagtcctgtttgttgagacttgagacgcatagagctagcgtcgacaatgtcgctcgtgaggaacagcaacgtgttcgaccccttctccatggacctctgggaccctttcgacaccatgatccgctccatcgacacgtcggcagtctccaccaactccgagaccggcgccttccggccagcgccctcatcaactggaaggagacgaccgaggcgccacgtgattcaaggcccgaccctcccccggcccacaacagggggaggaaggtccaaggccccacgggccgagggacaggcaaccgagcgtggggccgaacaaaacaaaccggccggagccaccggtacggagcgaaggaccaggggaacaacaaaagcaggaccaaccccgggggcctaaacaccagtcggtctcacctatttttctgtcgggggcacacttacccctcnctgggcgcgaataaacccctccactgttgttacacctgggggcgaagggcactggtcctcccgaagaacaatacaccgaggtcttctaaaactctaaactgctttgcgcctaaagttgtggtagagaggaaataaattccccggcgatcgtggctaa

SEQ ID NO: 39552 - protein, 115 aa, Zea mays
  misc_feature: Ceres CLONE 1429847-F
MSLVRNSNVFDPFSMDLWDPFDTMIRSIDTSAVSTNSETGAFRPAPSSTGRRRPRRHVIQGPTLPRPTTGGGRSKAPRAEGQATERGAEQNKPAGATGTERRTRGTTKAGPTPGA

SEQ ID NO: 39553 - DNA, 677 bp, Zea mays
  misc_feature: Ceres CLONE 1429850-F
  misc_feature: Translation starting site: 176
  misc_feature: Pfam Name: HIG_1_N Pfam Description: Hypoxia induced protein conserved region
  misc_feature (413)..(413): n is a, c, t, g, unknown, or other
  misc_feature (414)..(414): n is a, c, t, g, unknown, or other
  misc_feature (416)..(416): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (475)..(475): n is a, c, t, g, unknown, or other
  misc_feature (480)..(480): n is a, c, t, g, unknown, or other
  misc_feature (485)..(485): n is a, c, t, g, unknown, or other
  misc_feature (486)..(486): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (507)..(507): n is a, c, t, g, unknown, or other
  misc_feature (519)..(519): n is a, c, t, g, unknown, or other
  misc_feature (523)..(523): n is a, c, t, g, unknown, or other
  misc_feature (524)..(524): n is a, c, t, g, unknown, or other
  misc_feature (527)..(527): n is a, c, t, g, unknown, or other
  misc_feature (531)..(531): n is a, c, t, g, unknown, or other
  misc_feature (538)..(538): n is a, c, t, g, unknown, or other
  misc_feature (540)..(540): n is a, c, t, g, unknown, or other
  misc_feature (543)..(543): n is a, c, t, g, unknown, or other
  misc_feature (544)..(544): n is a, c, t, g, unknown, or other
  misc_feature (547)..(547): n is a, c, t, g, unknown, or other
  misc_feature (548)..(548): n is a, c, t, g, unknown, or other
  misc_feature (551)..(551): n is a, c, t, g, unknown, or other
  misc_feature (554)..(554): n is a, c, t, g, unknown, or other
  misc_feature (555)..(555): n is a, c, t, g, unknown, or other
  misc_feature (557)..(557): n is a, c, t, g, unknown, or other
  misc_feature (561)..(561): n is a, c, t, g, unknown, or other
  misc_feature (564)..(564): n is a, c, t, g, unknown, or other
  misc_feature (567)..(567): n is a, c, t, g, unknown, or other
  misc_feature (570)..(570): n is a, c, t, g, unknown, or other
  misc_feature (573)..(573): n is a, c, t, g, unknown, or other
  misc_feature (580)..(580): n is a, c, t, g, unknown, or other
  misc_feature (581)..(581): n is a, c, t, g, unknown, or other
  misc_feature (584)..(584): n is a, c, t, g, unknown, or other
  misc_feature (588)..(588): n is a, c, t, g, unknown, or other
  misc_feature (589)..(589): n is a, c, t, g, unknown, or other
  misc_feature (593)..(593): n is a, c, t, g, unknown, or other
  misc_feature (597)..(597): n is a, c, t, g, unknown, or other
  misc_feature (598)..(598): n is a, c, t, g, unknown, or other
  misc_feature (602)..(602): n is a, c, t, g, unknown, or other
  misc_feature (607)..(607): n is a, c, t, g, unknown, or other
  misc_feature (616)..(616): n is a, c, t, g, unknown, or other
  misc_feature (621)..(621): n is a, c, t, g, unknown, or other
  misc_feature (624)..(624): n is a, c, t, g, unknown, or other
  misc_feature (627)..(627): n is a, c, t, g, unknown, or other
  misc_feature (629)..(629): n is a, c, t, g, unknown, or other
  misc_feature (638)..(638): n is a, c, t, g, unknown, or other
  misc_feature (647)..(647): n is a, c, t, g, unknown, or other
  misc_feature (648)..(648): n is a, c, t, g, unknown, or other
  misc_feature (658)..(658): n is a, c, t, g, unknown, or other
  misc_feature (661)..(661): n is a, c, t, g, unknown, or other
  misc_feature (665)..(665): n is a, c, t, g, unknown, or other
  misc_feature (668)..(668): n is a, c, t, g, unknown, or other
aaaactggagctccccgcggtggcggccgctctagaactagtggatcccccgggctgcaggaattcgcacgagaccattacctagaacatcctaatcgaaaaatcaagcacgcatccaccacacacacagctagctagcagatcgtttcgagtgaagatccaaagaggtagagagatggaaaggatgagttcgtcgctgcagtactgggtggaggagcacaagctctcaaccatcggagccgtgtgggcgacggcggtgggcgcgtcggtggcgtacagccgggcgcgggcgccggcgcgggcgacgggcatgcgcctcatccacgccaggatgcacgcgcaggcgctcacgctcgccgtcctcgggggagcggcgctcgggcaccaataccacggaaagagcaccacgcccnngngggaaaaagggccaccccccccgggggaggaactctgggnnnnnnnnnncccccttccnttcanacggnnggggggggggcgcgnnntttntttcttcttccncccnnccnacancaaacancnacnnctnncgnccnncnccgncgncgncgnccnccgccgnncgnaaannccgncgcnnccgncacgncggtccggngcggncgncgngncgacgccgncgccgccgnncgcccgccgncgnaccnccnccggcgacc

SEQ ID NO: 39554 - DNA, 697 bp, Zea mays
  misc_feature: Ceres CLONE 1429853-F
  misc_feature: Translation starting site: 319
ccgcggtggcggccgctctagatctagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcgagaaatcgggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttaggttgggggccactgaaataatcgctagtgtcaaggctgaattaggaaaaccaagcattcttcaccctgacaaaggaaaagttgccatttttgtcgactgtagtccaaccgctgagcctctgtttgagggtagaggctctgaagaattgtctgctgagctctctgtttccctgcaaagatgcttgttgggtggtaaaagtggtgctggtgctgcaattgatctgtcatccc

SEQ ID NO: 39555 - DNA, 662 bp, Zea mays
  misc_feature: Ceres CLONE 1429854-F
  misc_feature: Encodes the peptide sequence at SEQ ID NO. 39556
cgctctagatctagtggatcccccgggctgcaggaattcgcacgagaccattacctagaacatcctaatcgaaaacaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgagttcgaccggctgagcgcgctcggcccggtggccaccctcgccggctcgcagtacacgctgaacctcacctacgacatggg

SEQ ID NO: 39556 - protein, 162 aa, Zea mays; identical to SEQ ID NO: 39115
  misc_feature: Ceres CLONE 1429854-F
  misc_feature (64)..(161): Pfam Name: Fasciclin Pfam Description: Fasciclin domain

SEQ ID NO: 39557 - DNA, 664 bp, Zea mays
  misc_feature: Ceres CLONE 1429855-F
  misc_feature: Encodes the peptide sequence at SEQ ID NO. 39558
  misc_feature (265)..(265): n is a, c, t, g, unknown, or other
  misc_feature (266)..(266): n is a, c, t, g, unknown, or other
  misc_feature (365)..(365): n is a, c, t, g, unknown, or other
  misc_feature (370)..(370): n is a, c, t, g, unknown, or other
  misc_feature (372)..(372): n is a, c, t, g, unknown, or other
  misc_feature (375)..(375): n is a, c, t, g, unknown, or other
  misc_feature (378)..(378): n is a, c, t, g, unknown, or other
  misc_feature (399)..(399): n is a, c, t, g, unknown, or other
  misc_feature (400)..(400): n is a, c, t, g, unknown, or other
  misc_feature (405)..(405): n is a, c, t, g, unknown, or other
  misc_feature (460)..(460): n is a, c, t, g, unknown, or other
  misc_feature (470)..(470): n is a, c, t, g, unknown, or other
aagctggagctccccgcggtggcggccgctctagaactagtggatcccccgggctgcaggaattcgcacgagaccattacctagaacatcctaatcgaaaacaggagagaagaggagtcgcatttcgcgtggtcgagtccgtccgtgtctgtcctccgctgtccgctggctgcgatagtgctgcctgctgctctaccccattccaaggaggatgccgaggagcccgcagctgagccctggagcgctgcagctctctctttctccnntgtcagcacagtacgagccgcgacagcgccgccctgaagggcgccgtgccagcgccaccggcaggcgcggtgcccccacggcgcacccctctcctgtcnctcancntcngcnaagaggaagaggacgagggtnnagacnaaagagattaccctgctgggggccgccgccctggatctgcagctgacggggcccngtggcggcancaacagcagcggcggctacaacgacgagcggaagaccatccggatgatgagaaacagggagtctgccctgcgctccaggcaaaggaaaagggcctatgttcaggaacttgaaaagggaagttcctccccctggtggaatgaaaacctcaagctcaagaggcggtgcaaaccactgaaactagatatggcttgcc

SEQ ID NO: 39558 - protein, 50 aa, Zea mays
  misc_feature: Ceres CLONE 1429855-F
MMRNRESALRSRQRKRAYVQELEKGSSSPWWNENLKLKRRCKPLKLDMAC

SEQ ID NO: 39559 - DNA, 657 bp, Zea mays
  misc_feature: Ceres CLONE 1429867-F
  misc_feature: Translation starting site: 573
  misc_feature (652)..(652): n is a, c, t, g, unknown, or other
aagctggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaaggtcaccaagctctgcgatttggggcctagggacagcgtatgcgcagtgcattggtcacgggaaggctcttatctttccattggcacccggccttggagatgtccagatttgggatagntctcg

SEQ ID NO: 39560 - DNA, 767 bp, Zea mays
  misc_feature: Ceres CLONE 1429873-F
ccaagctggagctcaccgcggtggcggccgctctatactagtggatcccccgggctgcaggaattcgcacgagaccattacctagaacatcctaatcgaaaatcgtccagttataaatactcttgcaaaaggcttagatatacgcctcaaccataaggttgtggaaattgttcgccaccggaacagggtagaggttactgtaagcagtggccaaacattcgttgcggacgcagcagtggtcactgttccgttgggtgtcctgaaagcgaaaaccatcagatttgaccctaggctgctagagtggaaataagagccaagcagagaagtgaccgatgttagcttgacaatccttggagcataacatcgagaacagttacgagaaggaccaactcctaccgtctttcaacaccgcccccccccacctggagacactagtgctttctggagatgaacagagaaaagcatggcggccgaaaaccatgtcgcataccttcataggatctccttggacagataatttcactcaccttggagagaggtttaccaaacacctctattgtttctgggacgccgtcattttggagcctggttttgggccctggctttctttactcatgattctgacctgcacattagtgagatacgctcccatgctgcgtttggcttttcagtcacatgcccgtggaaccgtggctacgactctcggatatctttgagaccccggaaccgcaatttctccaacggacgtttattgaacgacctttgtg

SEQ ID NO: 39561 - DNA, 668 bp, Zea mays
  misc_feature: Ceres CLONE 1429892-F
  misc_feature: Encodes the peptide sequence at SEQ ID NO. 39562
ccccgcggtggcggccgctctttcacagtggatcccccgggctgcaggatttcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaaccaagtagctcttggcaaaacttttctcctactctaagcaaaaaaaatttcttcatttcaccaactggctacattgaaccggggctgcttattggcggcaacaattattccctttcacccaggtaggtatggcctaatcttaagaaaaaaaaatttttttcatttaaaccatttggccccaactaaacccccgcttttttat

SEQ ID NO: 39562 - protein, 144 aa, Zea mays
  misc_feature: Ceres CLONE 1429892-F
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVIKPSSSWQNFSPTLSKKNFFISPTGYIEPGLLIGGNNYSLSPR

SEQ ID NO: 39563 - DNA, 748 bp, Zea mays
  misc_feature: Ceres CLONE 1429895-F
  misc_feature: Encodes the peptide sequence at SEQ ID NO. 39564
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (31)..(31): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (50)..(50): n is a, c, t, g, unknown, or other
nttttggggnnnnngggnnnntatttgtttngtttggtgnnntggtnggngtggtcgtgtgcaaactggagctcaccgcggtggcggccgctctagaactagtggatcccccgggctgcaggaattcgcacgagaccattacctagagcatcctaatcgcaaaaaacaaaaaaaccctatgaactccaaaaccttcagccccacgctatggctcctcgcactgcgcctccgtcgggtcctcgcggcggcctccaccgcggcacccctgctccgcccgtccacctcggtcgaccggtcttgcccgctcgttcccctcgcctccccggtcgcgccgctcccgctgccgccgtggagattcctgcccggcggcggcgccgggttcaggtccacggcggcggcggctgctcggggcaagacccactatcagacggacaacagccagatctcccccgacgagatcctcttcgagggctgcgaccaccactactggctcatcagcatggacttcccgggcccctagccgtcccgcgaacagacgagcgagacatacttccttactctaactcaaagtcgtcggggagtaatgaggagggtccagaaatataaatgtattgccttttaataccaaccgaccattaagtctggcactataagggccgggttagctgaaccccgatgggaatactcatacaacaaacaacaacatccccgccggcgcgaatacccccatgaactaaaaccagttatt

SEQ ID NO: 39564 - protein, 113 aa, Zea mays
  misc_feature: Ceres CLONE 1429895-F
MNSKTFSPTLWLLALRLRRVLAAASTAAPLLRPSTSVDRSCPLVPLASPVAPLPLPPWRFLPGGGAGFRSTAAAAARGKTHYQTDNSQISPDEILFEGCDHHYWLISMDFPGP

SEQ ID NO: 39565 - DNA, 831 bp, Zea mays
  misc_feature: Ceres CLONE 1429898-F
  misc_feature: Encodes the peptide sequence at SEQ ID NO. 39566
  misc_feature (11)..(11): n is a, c, t, g, unknown, or other
  misc_feature (12)..(12): n is a, c, t, g, unknown, or other
  misc_feature (19)..(19): n is a, c, t, g, unknown, or other
  misc_feature (29)..(29): n is a, c, t, g, unknown, or other
  misc_feature (30)..(30): n is a, c, t, g, unknown, or other
  misc_feature (42)..(42): n is a, c, t, g, unknown, or other
cccccgctacnnctccccnccccagcgannttttgctttctnttcaaactgggactccccgcggtggcggccgctctattctaaaggatcccccgggctgcaggagttcgcacgagaccattacctagaacatcctaatcgaaaaaaaacgagcatcgcagagattggcgtcttcatagtcgcctacctccgcggctcaaacctttcccccttctcccaattccctccgtcggccgccgctccatcccgtacgacgacaccatgagggagtgcatttccatccacatcggacaggccggtatccaggtcggaaacgcgtgctgggagctgtactgccttgcgcatggccttacaggcgaccgccagattgttctgtgacaagaccattgggggaggtgatgaagctttcatcacgtgttttcaagaacaccggtgctgggaagcacgtgccccgggctgatttcaggagagccgcgaagcccaccgtcccccactgaagtgacgactgggcccctagccgtcagggtctttccccccgtgaggcagttccaacccttggggcagggaggtatgcaggccacaaagcttccgcccccgtggctcgctacaaccattggcaaagggggagcgagggaccctggggactagggatcgggttgggggaaggcggggcctactcacaggtaacggattcccccggggttttaggcaggcaggcgtacccagttcggcggggaaaagaaagggcttccggggcccttgggacactcccccccgcgaagagaagggcacggagttgggggagaataccagagagaaaacgcccccctg

SEQ ID NO: 39566 - protein, 38 aa, Zea mays
  misc_feature: Ceres CLONE 1429898-F
MRECISIHIGQAGIQVGNACWELYCLAHGLTGDRQIVL

SEQ ID NO: 39567 - DNA, 772 bp, Zea mays
  misc_feature: Ceres CLONE 1429919-F
  misc_feature: Encodes the peptide sequence at SEQ ID NO. 39568
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (22)..(22): n is a, c, t, g, unknown, or other
  misc_feature (27)..(27): n is a, c, t, g, unknown, or other
  misc_feature (43)..(43): n is a, c, t, g, unknown, or other
  misc_feature (697)..(697): n is a, c, t, g, unknown, or other
nnnnnccccccccccccccccncccancccccccccccccccnggtagagggctaaaactggggctccccgcggtggcggccgctctagaactagtggatcccccgggctgcaggaattcgcacgagaccattacctagaacatcctaatcgaaaaattgcggaatttgcttcaccacaccttcatcagagagccgagacgacacgctcgagacccagcaaggcaagaagaacacgagagagacagcaggcaccaggcagggatcaatcatccgtccatggagaacctaaaggagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccagaagccgcagcccagtatcgccccgcccaagctcggccgcccccgccccggccccgccgacgaccactccccaaccggggaagggaagaagttccctgaactacctccgggtgttgttatcaaaggctgaaagaaggggctgcttctagtggcctggcacgcccccaggcgtttattttttttcgccaagaaggaaacacctttgttngaaggacaatccagggcccctcgcaggtgtttgcgttacaagggaacaccccggtgagctgcccaataaacaagg

SEQ ID NO: 39568 - protein, 113 aa, Zea mays
  misc_feature: Ceres CLONE 1429919-F
  misc_feature: SWISSPROT Homolog: EC 2.5.1.61 Hydroxymethylbilane synthase
MENLKEQRGHDAAGANAWMTVPAFGDWDTKNGALPDYSMDFSKIREMRKQNKKELSRASLGGDDDLLAHAQKPQPSIAPPKLGRPRPGPADDHSPTGEGKKFPELPPGVVIKG

SEQ ID NO: 39569 - DNA, 678 bp, Zea mays
  misc_feature: Ceres CLONE 1429920-F
  misc_feature: Encodes the peptide sequence at SEQ ID NO. 39570
  misc_feature (509)..(509): n is a, c, t, g, unknown, or other
  misc_feature (510)..(510): n is a, c, t, g, unknown, or other
  misc_feature (589)..(589): n is a, c, t, g, unknown, or other
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgcaaagctgtgctgtgcgccagctgctgcttccctacggcggctcccagtcgcgacggagaggtgcaggtgcttgcctgccgccagcatctccaccgcttggcgaggcgtcaggatnnctcgtcgcagcgcccgcgccgtcgccatcctcagctcgtcgggctccaccagcagccccgacagccgcgcctttgtagntgtccagcgccgcgtccacctcgggtgtcggcgggttcctagcggggcccccttaagccgcccccccgccccaacggttccaagtttcc

SEQ ID NO: 39570 - protein, 93 aa, Zea mays
  misc_feature: Ceres CLONE 1429920-F
  misc_feature (54)..(54): Xaa is any aa, unknown, or other
  misc_feature (80)..(80): Xaa is any aa, unknown, or other
MCSGGRCCPFRRSARKAVLCASCCFPTAAPSRDGEVQVLACRQHLHRLARRQDXSSQRPRRRHPQLVGLHQQPRQPRLCXCPAPRPPRVSAGS

SEQ ID NO: 39571 - DNA, 660 bp, Zea mays
  misc_feature: Ceres CLONE 1429934-F
  misc_feature: Encodes the peptide sequence at SEQ ID NO. 39572
  misc_feature (270)..(270): n is a, c, t, g, unknown, or other
  misc_feature (277)..(277): n is a, c, t, g, unknown, or other
  misc_feature (312)..(312): n is a, c, t, g, unknown, or other
  misc_feature (391)..(391): n is a, c, t, g, unknown, or other
  misc_feature (469)..(469): n is a, c, t, g, unknown, or other
ctccccgcggtggcggccgctctagaactagtggatcccccgggctgcaggaattcgcacgagaccattacctagaacatcctaatcgaaaaactagatttttggagtcttcttgctaaatcagggataagaccgccttgttgtttttgtgcctcgctagatcgttccgtaagggcacccatcgtcatagatacgattcataggttctgccactacttgtgcgcggagagccaagaaatgcgtcaggggttgtgaagggaaagagtgccngatgccngtggccaccccgcgccgctgcggccggtggtgttngcgatgaaaggccacccagggtctggcaagtccacggcggcgcgcgccatcgcgaccgcgctttgctgtccgctcctgnacaaggacgatgtgagggactgcatgttgcccctagagggcttggctgctgctgggatgctcaacaacctctcctacnccgtgctgtggcggatggccaagcgccaggtaaggctcggactgtctgtcttcatcaattcaccgctgtcacgccgctctcacctcgacatgctgacacgcctagccggtgtgcttgtggtcgtcgtgaagtgtcccctggtgataacaaggattgccccggaagctggaaacccctgggtcgctgttgca

SEQ ID NO: 39572 - protein, 115 aa, Zea mays
  misc_feature: Ceres CLONE 1429934-F
  misc_feature (26)..(26): Xaa is any aa, unknown, or other
  misc_feature (52)..(52): Xaa is any aa, unknown, or other
MKGHPGSGKSTAARAIATALCCPLLXKDDVRDCMLPLEGLAAAGMLNNLSYXVLWRMAKRQVRLGLSVFINSPLSRRSHLDMLTRLAGVLVVVVKCPLVITRIAPEAGNPWVAVA

SEQ ID NO: 39573 - DNA, 685 bp, Zea mays
  misc_feature: Ceres CLONE 1429948-F
  misc_feature: Encodes the peptide sequence at SEQ ID NO. 39574
aaagctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaaggaccaactttgccatgagagtcaacagtttcttgcgtcagctacgcactcatcctactcttaataagtttgttattaagttcgggctgcgcaggaagcacactcgccatgtcaacagatggattcgcttctg

SEQ ID NO: 39574 - protein, 143 aa, Zea mays
  misc_feature: Ceres CLONE 1429948-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTNFAMRVNSFLRQLRTHPTLNKFVIKFGLRRKHTRHVNRWIRF

SEQ ID NO: 39575 - DNA, 696 bp, Zea mays
  misc_feature: Ceres CLONE 1429952-F
  misc_feature: Encodes the peptide sequence at SEQ ID NO. 39576
gctctgtactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcgggccagtaaatagagcaacacaaaacccttcaaattaatggagacctctgcagcaaccccgacccggccgccacaccaggaggccacttccccatcgccatcgccctcgtcgtcgctgaggctgtggaggccagccgcgcagcgcaacatgcccaatcaggggtcccatctgagcgccgccaaggagcagggggctgggccgccgtttgctgaccgggctgccccaccccttccggggttcgtaaacgtccaccttctcc

SEQ ID NO: 39576 - protein, 37 aa, Zea mays
  misc_feature: Ceres CLONE 1429952-F
MPNQGSHLSAAKEQGAGPPFADRAAPPLPGFVNVHLL

SEQ ID NO: 39577 - DNA, 727 bp, Zea mays
  misc_feature: Ceres CLONE 1429954-F
  misc_feature: Encodes the peptide sequence at SEQ ID NO. 39578
  misc_feature (525)..(525): n is a, c, t, g, unknown, or other
  misc_feature (589)..(589): n is a, c, t, g, unknown, or other
  misc_feature (605)..(605): n is a, c, t, g, unknown, or other
  misc_feature (606)..(606): n is a, c, t, g, unknown, or other
aagctggagctccccgcggtggcggccgctctagaatagtggatcccccgggctgcaggaattcgcacgagaccattacctagaacatcctaatcgaaaagtcgctcttcgtcgtctccccccacaactgttatattcccaccggcgccgccggctcttcgtcgtcctcctccgggtgtgccccagttcgctgcccgttccccagccgccgatccctcgatctccgctagcttcgttccttcgtacaggaacggtcgagcagaaactagcagccactcccgagtcccgactcccgatcgcgattacttgccgcggcaccagtactccagcggccaccatgagcagcgggaagcgatccttcttcgcgcccaagaagaaggccaccaacccgttcgattccgactccgacgacgacaaaccgcagcagcggccagcgcgggcgtcctccgtgcctcccccggacgagcagcggggctcctcctctctcttcggcgccggcgacagaggcgggctcttctcttccgncgccaagcatcactaccggaacgacttccgcgacgctggcggcctttgaggccagtccgtgcangagctggagggctacnncgcgtacaaggccaagagaccacgcgcggaacgcggggtgcgtcaggatcgcccaggagatgaaggaacacgcatccaagacgctcgtcaccgtccaccagcaggggcagcagatccaccg

SEQ ID NO: 39578 - protein, 78 aa, Zea mays
  misc_feature: Ceres CLONE 1429954-F
  misc_feature (63)..(63): Xaa is any aa, unknown, or other
MSSGKRSFFAPKKKATNPFDSDSDDDKPQQRPARASSVPPPDEQRGSSSLFGAGDRGGLFSSXAKHHYRNDFRDAGGL

SEQ ID NO: 39579 - DNA, 725 bp, Zea mays
  misc_feature: Ceres CLONE 1429956-F
  misc_feature: Encodes the peptide sequence at SEQ ID NO. 39580
  misc_feature (1)..(1): n is a, c, t, g, unknown, or other
  misc_feature (25)..(25): n is a, c, t, g, unknown, or other
  misc_feature (29)..(29): n is a, c, t, g, unknown, or other
  misc_feature (33)..(33): n is a, c, t, g, unknown, or other
  misc_feature (570)..(570): n is a, c, t, g, unknown, or other
ncaaaagtccataacggggctggcngcangaantcgtgccctaccaagagcgagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaaggaggaggtgagggagtatgagagcgacatgaggaagctggaggagctgctttctaagctgaacccctcggcggaggagttcgtgccgcagtcccgccgccgcgtggacggcggcgctccccgcctttcggccgacgcgcccgtgttcgtgtcgccggcgatcgactactacgcgcgccaccaccagctcccgccgccgcagcttctgcagcagcagcagccgatgcacgggcctncattttgtgggtggcgtccggcggggttggcaatgggtggcggcgggggggattggactccagcagcgacgggatcccgccaagggtcaggccgaaatccgacgggaggaaggaacggttttccatccgggggtaaggagaacgatgaatggggg

SEQ ID NO: 39580 - protein, 172 aa, Zea mays
  misc_feature: Ceres CLONE 1429956-F
  misc_feature (57)..(74): Pfam Name: PAM2 Pfam Description: Ataxin-2 C-terminal region
  misc_feature (121)..(121): Xaa is any aa, unknown, or other
MVAVAVDGLIRGADAVPAAEREAVRAAAAEAAAKGGEGESGKEEVREYESDMRKLEELLSKLNPSAEEFVPQSRRRVDGGAPRLSADAPVFVSPAIDYYARHHQLPPPQLLQQQQPMHGPXFCGWRPAGLAMGGGGGDWTPAATGSRQGSGRNPTGGRNGFPSGGKENDEWG

SEQ ID NO: 39581 - DNA, 673 bp, Zea mays
  misc_feature: Ceres CLONE 1429958-F
  misc_feature: Encodes the peptide sequence at SEQ ID NO. 39582
  misc_feature (578)..(578): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaaacttcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggtgcggaggacggagtggtcgaacgggaccgcaaggaggacctgcggtggtgcaagcaggcgtgcgagtggcactacggaaaggacacctcgcggaagagggaatgcgagagcaagtgcctccagcggcactagcaagctgacgcgtgcgaggacggcgacagcggcgtggacgcctacgtctccctctccggcaggggcgagtgctggccccagtgcctgcgcctctcgagggccagccgtgagagactcatgaatgcatgaggcggtgccagcgtcgtgnactggccgtcaacatggagctagagtacagtcgcggtcntcagagctctggcaagtgccggtagaagtgcgagcgccacaccgcggggactgatg

SEQ ID NO: 39582 - protein, 71 aa, Zea mays
  misc_feature: Ceres CLONE 1429958-F
MGKGSVGASWWAFLLLAGVLLVVAATAGAEDGVVERDRKEDLRWCKQACEWHYGKDTSRKRECESKCLQRH

SEQ ID NO: 39583 - DNA, 728 bp, Zea mays
  misc_feature: Ceres CLONE 1429963-F
  misc_feature: Translation starting site: 140
  misc_feature: SWISSPROT Homolog: EC 2.7.7.6 DNA-directed RNA polymerase
  misc_feature (728)..(728): n is a, c, t, g, unknown, or other
aagctggagctccccgcggtggcggccgctctagaactagtggatcccccgggctgcaggaattcgcacgagaccattacctagaacatcctaatcgaaaaaatcccagatccacccctccccatctccatccgcggccatggcctccgccgacgccggcacttgcccgtgggatgccctcccgttgcacctccaggagcgaatcctctccctcctccccatcaccgaactacttcccgttgccgccgtgtgccgcgccttccaccgacttctgcgctccccgaccttccatgccctcctctccccgcatcgcctcgacgccttcttcctcctttccccacggatcgccgtccacccactgtcccgccgcgtccgcactatgcccgcgttcgccgcgctctctcctccatcctacccgctcgtctcctccccgtacccatgactccttatcacctgagcctcactccgattcctcccgccgatccccgacggagcctacctcctatccgctatcggcccatcgcgcggatgcttcgactcctgcaccctatgagccgacttcaccggagcagacgcagcttcttacaccctggacaccgacgatccctccccgcattgcgcgtatgaaggcgatctcgccctgactctcacgctactggaaacgccgcggtctccggtgacagctcaatatcttgcgcctcgtcgtggtcgcgatgcgctcttggatn

SEQ ID NO: 39584 - DNA, 652 bp, Zea mays
  misc_feature: Ceres CLONE 1429969-F
  misc_feature: Encodes the peptide sequence at SEQ ID NO. 39585
  misc_feature (352)..(352): n is a, c, t, g, unknown, or other
  misc_feature (357)..(357): n is a, c, t, g, unknown, or other
  misc_feature (359)..(359): n is a, c, t, g, unknown, or other
  misc_feature (387)..(387): n is a, c, t, g, unknown, or other
  misc_feature (389)..(389): n is a, c, t, g, unknown, or other
  misc_feature (545)..(545): n is a, c, t, g, unknown, or other
ggagctccccgcggtggcggccgctctagaactagtggatcccccgggctgcaggaattcgccgagaccattacctagaacatcctaatcgaaaaccaagggccaaggcagggcactgcactgcacgcatgcactgacctgacgacgacgcgcgccacagtccacagctccacactcagacatggcgatgggcgccgcttccatcctactgatgatggtttcgctggaggccctgcttctcgccgccgccgccggcgccggcgggaccatccgtctgcccagcgatgtcggaggcgttgctgcagaccttgtcacggcaatggcgagggcgaaggcaagggcaaagcatcancttcncnaacaaagagagccgtggggggaatgctncnacttggccgtatgcgtcaagacgtaccggctaacttgctcgtgcttcgatcgggttgagcgctgctccgacgcctgtaaggagtgcggtgaaacggaggactcgcgccacgtctgcgtcgacaggtacggtggcgaccccggcccccagtgccacnacaaagaagggaaggagcgcggacccgctgacaacgacgctggtgggcaagcgaccccgaccggagttatggcaaataacaaaaaacagggcggcggcaacaacaaa

SEQ ID NO: 39585 - protein, 157 aa, Zea mays
  misc_feature: Ceres CLONE 1429969-F
  misc_feature (57)..(57): Xaa is any aa, unknown, or other
  misc_feature (59)..(59): Xaa is any aa, unknown, or other
  misc_feature (60)..(60): Xaa is any aa, unknown, or other
  misc_feature (69)..(69): Xaa is any aa, unknown, or other
  misc_feature (70)..(70): Xaa is any aa, unknown, or other
  misc_feature (122)..(122): Xaa is any aa, unknown, or other
MAMGAASILLMMVSLEALLLAAAAGAGGTIRLPSDVGGVAADLVTAMARAKARAKHXLXXQREPWGECXXLAVCVKTYRLTCSCFDRVERCSDACKECGETEDSRHVCVDRYGGDPGPQCHXKEGKERGPADNDAGGQATPTGVMANNKKQGGGNNK

SEQ ID NO: 39586 - DNA, 656 bp, Zea mays
  misc_feature: Ceres CLONE 1429972-F
  misc_feature: Encodes the peptide sequence at SEQ ID NO. 39587
  misc_feature (289)..(289): n is a, c, t, g, unknown, or other
  misc_feature (316)..(316): n is a, c, t, g, unknown, or other
  misc_feature (318)..(318): n is a, c, t, g, unknown, or other
aagctggagctccccgcggtggcggccgctctagaactagtggatcccccgggctgcaggaattcgcacgagaccattacctagaacatcctaatcgaaaaaattcgtttatagcgagcacaccagcgaaccagagattcatcagagtggcgatggccccgagcgcgtcgatgctgttcctgagctaccaccagctccacaggccgacggaggtggggacgccgccgccgccgccgcgcagggaggcggctgcccccggtggcttctggaggaggatgagcgtgagcancctgctctcacccgctttgtgcagtgncngccggagggggaggcaacactgcacgaacgcgacgccggcgaggagatcaagtcatcggcgccggccgacgctgataaagagcttgaaaagcagttcgaggaggcgctgcgcctcagctgctggtcttcatgagcatcccatcatcatggggaacggaaagacgcgagcgtgccgctaaatcgaagcgacctctcctctaaacagccgtcctgtatatcttcctcgtgtatcaaaaatccatcctttgctttagatttttggacatttggaatcgccacatcccgctccaatatggtatatatattttaggttgggagcaaaaaaaaaaaaaaaaacc

SEQ ID NO: 39587 - protein, 114 aa, Zea mays
  misc_feature: Ceres CLONE 1429972-F
  misc_feature (46)..(46): Xaa is any aa, unknown, or other
  misc_feature (55)..(55): Xaa is any aa, unknown, or other
  misc_feature (56)..(56): Xaa is any aa, unknown, or other
MAPSASMLFLSYHQLHRPTEVGTPPPPPRREAAAPGGFWRRMSVSXLLSPALCSXXRRGRQHCTNATPARRSSHRRRPTLIKSLKSSSRRRCASAAGLHEHPIIMGNGKTRACR

SEQ ID NO: 39588 - DNA, 669 bp, Zea mays
  misc_feature: Ceres CLONE 1429977-F
  misc_feature: Encodes the peptide sequence at SEQ ID NO. 39589
aaagctggagctccccgcggtggcggccgctctagaactagtggatcccccgggctgcaggaattcgcacgagaccattacctagaacatcctaatcgaaaaaccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaggcggtgggcggcgggcagtgcccggccctggggtgcgcggcggacctcaacgccgggtgcccgccctcgcagcgcgtgccgggggccgggggggcggcgtggtggcctgcaagggcc

SEQ ID NO: 39589 - protein, 175 aa, Zea mays
  misc_feature: Ceres CLONE 1429977-F
  misc_feature (34)..(172): Pfam Name: Thaumatin Pfam Description: Thaumatin family
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPQAVGGGQCPALGCAADLNAGCPPSQRVPGAGGAAWWPARA

SEQ ID NO: 39590 - DNA, 677 bp, Zea mays
  misc_feature: Ceres CLONE 1429990-F
aaagctggagctccccgcggtggcggccgctctagaactagtggatcccccgggctgcaggaattcgcgcgagaccattacctagaacatcctaatcgaaaacatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgcccgccgcggtccacctgccaccgccggttcatgtgccgccgccggttcatctgccgccgccaccatgccactaccctactcaaccgcccccggctcagcctcatccccagccacccccatgcccgtgccaaaagccgcatccaaaccccgggcccacctgcagggaaccttgcggggttggggaccccccccatccctggcccatggcccccgagttcttaaaggaataagggaaccccaaagggaaacccccatttgtcccccctaaagcccaattttttcggaaacagttgttccccccccccccggggggtggagcccca

SEQ ID NO: 39591 - DNA, 683 bp, Zea mays
  misc_feature: Ceres CLONE 1429991-F
  misc_feature: Encodes the peptide sequence at SEQ ID NO. 39592
  misc_feature (193)..(193): n is a, c, t, g, unknown, or other
  misc_feature (330)..(330): n is a, c, t, g, unknown, or other
  misc_feature (372)..(372): n is a, c, t, g, unknown, or other
atagctggagctccccgcggtggcggccgctctagaactagtggatcccccgggctgcaggaattcgcacgagaccattacctaagaacatcctaatcgaaaaaccgcaaggatccaccacaacagcgaaggagaaagcagaccaacctagccacccagggagaaagaggccaaaagggaggggagagtgtcntcatggcttccattgtcgcttccaggagggccgttcctctagttcgcgctctggagaagctcatcgcagcgtcctccgctcccgggactggctccgccctcaggccggtggcagtcgccggcggcctccgcggctancacaccggcgctccgctccgacgctacgagggggccgagtcngaagacgatagcgtccgcgagtacgatgggcggcacggcggcccgggactacgctgtgccccagcctgtctcagatatttttcggtgatccgcttagtgcgccgcacagcatgggccgcctgctgaaacttgtggacaacttggcgggggcggcccccaggtcgtgccggtgcgccgtggctggaaccccaaaggaggacgaggaggcccttccccttgagggtggacatgcccgggcctggggaaggaaccccttcaaggtgggggcggaccaaaaccctcctggtaatcaagggcgagggccaaaagga

SEQ ID NO: 39592 - protein, 100 aa, Zea mays
  misc_feature: Ceres CLONE 1429991-F
  misc_feature (45)..(45): Xaa is any aa, unknown, or other
MASIVASRRAVPLVRALEKLIAASSAPGTGSALRPVAVAGGLRGXHTGAPLRRYEGAESEDDSVREYDGRHGGPGLRCAPACLRYFSVIRLVRRTAWAAC

SEQ ID NO: 39593 - DNA, 700 bp, Zea mays
  misc_feature: Ceres CLONE 1429997-F
  misc_feature: Encodes the peptide sequence at SEQ ID NO. 39594
  misc_feature (311)..(311): n is a, c, t, g, unknown, or other
  misc_feature (312)..(312): n is a, c, t, g, unknown, or other
  misc_feature (392)..(392): n is a, c, t, g, unknown, or other
  misc_feature (399)..(399): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccattacctagaacatcctaatcgaaaaacggcataccataccggcaccggcagcgagcagtcgggagccatggctccgccgctcctgctcttcttcctcctcctccccctcctcacggccctcgctgacggacaccagcacctgtcctcctacggctcctccgcgctctccgattggcgccccgccaggcatcctactacgccgccgaccccgaagacgccatcgggtgggcgtgcnnggttcgggatctggggaaacacggctacggaatggcgacggtggggctgaacacggcccttttttgagcgccgtgcggcntgccgcnnctgctaccaagtcaagtccgtccaggacctcaagtactgcctccccggcacctccatcgtcgtcccggcaaccaacttctggcccccaaaatacggccttccccgcgacggcgggggccactgtaacccccccaaaccaccatttccctcctacccattccagtcgttttaaaaaaatccccgctttgggaagggcccggcatccatgccccatccaattaccggccgttgtttaatgcccccccccgaagggggggtggtagggtttttcccgtcaaaaggggtcggtatctttctttc

SEQ ID NO: 39594 - protein, 72 aa, Zea mays
  misc_feature: Ceres CLONE 1429997-F
  misc_feature (57)..(57): Xaa is any aa, unknown, or other
MAPPLLLFFLLLPLLTALADGHQHLSSYGSSALSDWRPARHPTTPPTPKTPSGGRAXFGIWGNTATEWRRWG

SEQ ID NO: 39595 - DNA, 605 bp, Zea mays
  misc_feature: Ceres CLONE 1430008-F
aaagctggagctccccgcggtggcggccgctctagaactagtggatcccccgggctgcaggaattcgcacgagaccattacctagaacatcctaatcgaaaacaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtgggcggggcccgtcccccactttccttggacttcctgaaaaaaacccgggtttttttgaaacctttccaaaaaccgggaaaaaaaaccaaaaggggggggggggaaacccatctttttttgcccaaaaaagaacattggtttttctcggggccaaaaaaaaaaaaaaaaaaaaatttttctcccccccccccccccccccccaaaaaaaaataatttttgtg

SEQ ID NO: 39596 - DNA, 675 bp, Zea mays
  misc_feature: Ceres CLONE 1430011-F
  misc_feature: Encodes the peptide sequence at SEQ ID NO. 39597
atagctggagctccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcgggactactacaacctgctgcaacaaacccccgatgtcgtcccacagttctacagcgaaagcagcaccatggtccgcgtcgacgacctcaccggcacgaccgctgctgccaacaacatgatggacatacactcactcatcatgtctttgaacttcacccaaatgagatcaagactgccaatttgtgaactcatggggcgatggggtgctagttatggtctctggtctattgcagaccagggagtacacccaccaaagaattttatccagatgttctccctcgcccctcaagaaaagggtactttgttcctcaacaattactttcccttcgttgaccaagaacatgttcagccctgcccccgtgattgctcaggaaaacctcaagaaccattttggccccccaaaacagtttgtgaaaaccccctcctgaagtccttccccgagaaagaaacttcaacaaatt

SEQ ID NO: 39597 - protein, 169 aa, Zea mays
  misc_feature: Ceres CLONE 1430011-F
  misc_feature (10)..(125): Pfam Name: NTF2 Pfam Description: Nuclear transport factor 2 (NTF2) domain
MASAAAATQVGTYFLRDYYNLLQQTPDVVPQFYSESSTMVRVDDLTGTTAAANNMMDIHSLIMSLNFTQMRSRLPICELMGRWGASYGLWSIADQGVHPPKNFIQMFSLAPQEKGTLFLNNYFPFVDQEHVQPCPRDCSGKPQEPFWPPKTVCENPLLKSFPEKETSTN

SEQ ID NO: 39598 - DNA, 664 bp, Zea mays
  misc_feature: Ceres CLONE 1430019-F
  misc_feature (290)..(290): n is a, c, t, g, unknown, or other
aagctggagctccccgcggtggcggccgctctagaactagtggatcccccgggctgcaggaattcgcacgagaccattacctagaacatcataatcgaaaaatcgatcgtcaatgcaagtttgtccattcgcattggtctgaatactgtagctactagcgcgagtgccactgtgccgcagctgcctgctcgccattactgcaagctgtgttcaatccaaagtttaattaggctccctctacatctgatccagctaaagtagctagccagcactacagaaaggcgtggcangaatcaggagagagatagcaggggggctagctagctgagctcgtgccaccaagaaatgccgggaatgggagggacatggtggccccgctcctggtgctcaacctcatcatgtacatcatcgtcatcggcttccggagctggaacctgaacacttcatcaacgggcaaacaactaccccggcgtggccggcaacggcgcgactttctacttcctggtgttcccatcctgcccgggtgggtgggcgcgcgtcccaactgggggggtgcacaagtgcgcgcctgggccacaacagcttgccacaaacccccgttttcctcatggcctgggcatcacgccctccccttcgggttggcctaaagaaatccccaccgcga

SEQ ID NO: 39599 - DNA, 654 bp, Zea mays
  misc_feature: Ceres CLONE 1430025-F
  misc_feature: Encodes the peptide sequence at SEQ ID NO. 39600
  misc_feature (316)..(316): n is a, c, t, g, unknown, or other
  misc_feature (654)..(654): n is a, c, t, g, unknown, or other
ctggagctccccgcggtggcggccgctctagaactagtggatcccccgggctgcaggaattcgcacgagaccattacctagaacatcctaatcgaagagcccactcccagaggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctngtgggcaatgttagaacaacgcaggcctcccagacagcggtgaagagcccttcgtctctaagcttcttcagccaaagtaccgagggtcccaagccctgagacctccaggaaactggatgtctccgccttggctgtttacaggggtgagctttggcgggcttgaagtgtaaaacccgaatttgatgctcccaaacaaccccctacttcctttaacccaacccaaaactggccggggtggaattttccataactcgggcggggtggggggttggccccaccctggggcgggaaaaaaatcaaatctggggtccgggttaaaccaaccgggatggggcccn

SEQ ID NO: 39600 - protein, 44 aa, Zea mays
  misc_feature: Ceres CLONE 1430025-F
MSTSTFATSCTLVGNVRTTQASQTAVKSPSSLSFFSQSTEGPKP

SEQ ID NO: 39601 - DNA, 674 bp, Zea mays
  misc_feature: Ceres CLONE 1430026-F
  misc_feature: Translation starting site: 205
  misc_feature (336)..(336): n is a, c, t, g, unknown, or other
  misc_feature (659)..(659): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaaaggcatgctccacgacagggggccgacngcgtcgcaggcgctgacggtggtgacgctgttcccgctggggcggctgctgctggtgctgtcggggctggcgctgaccgccttccgtggtggggctggccgtggccaccgcggtgttcctgaatctcagccccgtgctcgtccccgccgcgctgctcaatcggaccgccgtcatggggtttcttcaacgtcggccgcctggggcttcggggccctgtcctcgctcacgtgcctccccaacacggcgcgggagggcgttccagcgcaccccggactacggtgaaggaggcccaccccaagatgggccgaagcccccgccccacnccgggccacaagacc

SEQ ID NO: 39602 - DNA, 690 bp, Zea mays
  misc_feature: Ceres CLONE 1430029-F
  misc_feature: Encodes the peptide sequence at SEQ ID NO. 39603
gctctagaactagtggatcccccgggctgcaggaattcgcacgagaccattacctagaacatcctaatcgaaaactagcccccgaatcagatcccaccgcccgccggagcgcggaaccctgcccccggccgccatggacatgagcgatgcggagcggctgttcttcttcgagatggcctgcaacaactccgaggtcgcgtacgagcagaaccccaacgacgccgacaacttgacgcgatggggcggagcgctgctggagctatcgcagctgcgtaacggccccgacagcttcaagctcctcccagatgcggaagccaagctggaggaggcactgcaaattgatcccaacaagtctgatgcactctggtgcttgggaaatgctcagacttctcatggattcttcactccagacactgcaattgcaaatgagttctttgcgaaggcaactgaatgtttccagaagctgctgatgtggaacctgcaaatgagctggtacagaagtcattagacttgtcagcgagggcccctgaactgccctccgagaatccacagcaaatggcttctctagcggaaacacagcattctcagcctcaaatcccacgaatccagggaggaaaagaaagaaggaccccaacttctgggaacaattttggggaggggggatcccttggcccgggcattttgccttgg

SEQ ID NO: 39603 - protein, 124 aa, Zea mays
  misc_feature: Ceres CLONE 1430029-F
  misc_feature (6)..(123): Pfam Name: TOM20_plant Pfam Description: Plant specific mitochondrial import receptor subunit TOM20
MDMSDAERLFFFEMACNNSEVAYEQNPNDADNLTRWGGALLELSQLRNGPDSFKLLPDAEAKLEEALQIDPNKSDALWCLGNAQTSHGFFTPDTAIANEFFAKATECFQKLLMWNLQMSWYRSH

SEQ ID NO: 39604 - DNA, 615 bp, Zea mays
  misc_feature: Ceres CLONE 1430033-F
  misc_feature: Encodes the peptide sequence at SEQ ID NO. 39605
tcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacgggcgacagcggcgtggacgcctacgtctcccgctccgggaggggcgagtgccggcgcccagtgcctgcgccgccacgagggccagccgtgggagacccaggagtgcatgagggtgtgccgccgccgcggaatggccgtccaacatggagcaagataccggtcgcggcaccaagagcccgggcaagtgccggggagaggtgccagcccc

SEQ ID NO: 39605 - protein, 115 aa, Zea mays
  misc_feature: Ceres CLONE 1430033-F
MGKGSVGASWWAFLLLAGVLLVVAATAGAEDGVVERDRKEDLRWCKQACEWQYGKDTPRKRECESECRERHQQADAGEDGRQRRGRLRLPLREGRVPAPSACAATRASRGRPRSA

SEQ ID NO: 39606 - DNA, 680 bp, Zea mays
  misc_feature: Ceres CLONE 1430034-F
  misc_feature: Encodes the peptide sequence at SEQ ID NO. 39607
aagctggagctccccgcggtggcggccgctctagaactagtggatcccccgggctgcaggaattcgcacgagaccattacctagaacatcctaatcgaaaaactgccctggtcccccattcaattcttccaactccgccgcttcgcctcgttccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagcgcgtgtttgtgaacaaggtgtcgtgcaagcttgcgggggacctcgccaaactgcggctctcctttcagagcgacccgcaggggcagtggcaaggggggcggggaaggaaagggacccccctacagcagcttcttcgccgcgccggttgggtggggctcatcaccaaggcgttttctccgtgctcctacaacgtcgaagggcacgcaaccgcgctgcctccgcagaagacttgctcccctccccggaagggcgccggtccagcttcc

SEQ ID NO: 39607 - protein, 171 aa, Zea mays
  misc_feature: Ceres CLONE 1430034-F
MASAAATTTSAPAQNLNPLSINIKLPPWLSGLRCPFTFVCPPPPPPPPPPPPPPPLPPTEPVVPRSRRLPSLRVTTEYDSEERVFVNKVSCKLAGDLAKLRLSFQSDPQGQWQGGRGRKGTPLQQLLRRAGWVGLITKAFSPCSYNVEGHATALPPQKTCSPPRKGAGPAS

SEQ ID NO: 39608 - DNA, 657 bp, Zea mays
  misc_feature: Ceres CLONE 1430038-F
  misc_feature: Encodes the peptide sequence at SEQ ID NO. 39609
  misc_feature (466)..(466): n is a, c, t, g, unknown, or other
  misc_feature (484)..(484): n is a, c, t, g, unknown, or other
  misc_feature (536)..(536): n is a, c, t, g, unknown, or other
aaagctggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacgggtggcttcttctggctggtgaacccacgcgtgncggaagagctgatgggcngcatgctccgcggggtgcgccagttcacgagggccccgtggaagcgaagcangcgctctactccagggacctggctcggcacctgcgcttcggctccaacttcgacctcttaagggcgctgcggccgactggcgcgcacgctcttctgcgaggtggctccgaacccgccgccg

SEQ ID NO: 39609 - protein, 149 aa, Zea mays
  misc_feature: Ceres CLONE 1430038-F
  misc_feature: SWISSPROT Homolog: EC 1.14.11.20 Desacetoxyvindoline 4-hydroxylase
  misc_feature (107)..(107): Xaa is any aa, unknown, or other
  misc_feature (113)..(113): Xaa is any aa, unknown, or other
  misc_feature (130)..(130): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTGGFFWLVNPRVXEELMGXMLRGVRQFTRAPWKRSXRSTPGTWLGTCASAPTSTS

SEQ ID NO: 39610 - DNA, 664 bp, Zea mays
  misc_feature: Ceres CLONE 1430040-F
  misc_feature: Translation starting site: 162
ggagctccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaattgagatcaggactggcaattttgtgaactcatggggcgatggggtgctagttatggtctctggtctagtgcagaccaaggagtacagccaccaaaagaaatttatccagatgttcttccttgcccctcaagagaagggttactttgtccctcacgatttacttcacttcgatgaccagaacatgtgcagcctgccccagtgattgctcaagaagactacgagagcattttgccacccacaaaagttgtgagaccgctcctgattaccttcacgaaggaagaactcaacaaatagc

SEQ ID NO: 39611 - DNA, 728 bp, Zea mays
  misc_feature: Ceres CLONE 1430045-F
  misc_feature: Translation starting site: 201
gagctcccccgcgggggcggccgctctagacctagtgaatccccgcggctgcaggaattcgcacgagaccattacctagaacatcctaatcgaaaaagacaactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtcgggcgcgctggggctcgggggcctgtcctcgctcacgtgcctcgccaacacggcgcggcaggcgttccagcgcaccccggactacgtggaggaagcgcaccgcatgatggcggaggccgcggcgcacgcgggccacaagaccgcgcaggcaggccatggccttccaggcaaggcgcatgaagcctgcccctggggaggtgcatgtgcc

SEQ ID NO: 39612 - DNA, 620 bp, Zea mays
  misc_feature: Ceres CLONE 1430046-F
  misc_feature (277)..(277): n is a, c, t, g, unknown, or other
  misc_feature (301)..(301): n is a, c, t, g, unknown, or other
  misc_feature (341)..(341): n is a, c, t, g, unknown, or other
  misc_feature (359)..(359): n is a, c, t, g, unknown, or other
ggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccngccgcggtgcatctgccaccttcngttcacctgccacctccgtgcatctcccaccgcgggtcancttgccgcggccggtcancctgcaccgcccggtcatgttgccccccccggttcatttgcccgcgcccccatggccttaccctattaaaccgccccgggcttaggctttttccccagccaacccatggccggggcaaaaagccgaatccaaacccggtggcaattgaaggggacctgcggggttttggaaccccccaaacctcgggccattgggcaaaatccctgaagggataaggggcccccaggggggaacccccttttggctccccccaagggcggg

SEQ ID NO: 39613 - DNA, 665 bp, Zea mays
  misc_feature: Ceres CLONE 1430049-F
  misc_feature (381)..(381): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcacccctacaggatccaacaggcaatcacagctggcatcttacctttatcacccttgttcctncgacgatcatcagccctattacatcagttacctttggtgcatttatgggcacaaacatcagggcacacaactacaacaactgtgctagcaaactttgctgctactctcagcaacacagttttctccaatcaaccaaataactggattgaactctgcttcttatttgcaaaaccacaactaccttttcggtgggaaaacttttccccttatttaaaaaaaaaaatttttttcatttcacccaattgtttaaactgaaacctggtttgttttttgaaaaaaaaaat

SEQ ID NO: 39614 - DNA, 686 bp, Zea mays
  misc_feature: Ceres CLONE 1430050-F
  misc_feature: Encodes the peptide sequence at SEQ ID NO. 39615
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaaacctttctccttactctcagaaaaaaaaattttcttcattccaacaactggtctaccctgaaccccggttgtttatttggcggaaccaactactttctccctttcgggccgtttagtttctggcctattttcagaaaaaaacattttctttccattaaaacaatttccgcccaattaaaccccctttg

SEQ ID NO: 39615 - protein, 129 aa, Zea mays
  misc_feature: Ceres CLONE 1430050-F
MAAKIFSILMLLALSACVANATIFPQYSQAPIAALLPPYLPSMTASVCENPALQPYRLQQAIATSNLPLSPLFFQQSPALSLVQSLVQTIRAQQLQQLVLPVISQVALAKPFSLLSEKKIFFIPTTGLP

SEQ ID NO: 39616 - DNA, 719 bp, Zea mays
  misc_feature: Ceres CLONE 1430052-F
  misc_feature: Translation starting site: 294
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (40)..(40): n is a, c, t, g, unknown, or other
  misc_feature (45)..(45): n is a, c, t, g, unknown, or other
  misc_feature (59)..(59): n is a, c, t, g, unknown, or other
nnnnnnnnnnnnnnnnnnnncctcccacctcccggtacancccanacaaaaggggagtntccccaaactggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagccgtgcggtggagcagtactcgccgatccccgtacgtggcgacgctgctgaactgcatgatgtgggtgctgtacggcctgccgctggtgcacccgcacaggatgctgggggggaccatccaacggcgccggcatgtccattccagctgacctagggggggctcttcatccctttgctccccaggggggggggtgcgccccccaggggcctggctccctgttccgcccgcccagaggccgcccttccggtcgttcacccttggcgcccgccccggggggaccacaccctcgggggacgaaagagcccttttaggcgggg

SEQ ID NO: 39617 - DNA, 715 bp, Zea mays
  misc_feature: Ceres CLONE 1430054-F
  misc_feature: Encodes the peptide sequence at SEQ ID NO. 39618
  misc_feature (630)..(630): n is a, c, t, g, unknown, or other
  misc_feature (665)..(665): n is a, c, t, g, unknown, or other
aagctggagctccccgcggtggcggccgctctatactagtggatcccccgggctgcaggaattcgcacgagaccattacctataacatcctaatcgaaaaaaactactccgtcactttgtttgcaaagctcctcctcgatccctcgatcactgcaccggccggttactacgttgtgatttgtacgtcgacgagatcactggtcgggtggcggacgacgacacatggggaagggtagtgtgggtgcatcatggtgggcggttccttcctgctcgccggcgtgctgctggtcgtagcagccacggccggggcggaggacggagtggtccaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgagggcgtgccgcccgccgcgactggccgtcgacatggagcaagagtaccgtcgcggcaccnagagcgcgggcaagtgccgtggagaagtgctagcncccacaccgcgggggactggttgggagagcaaccctgcttgatgactcaa

SEQ ID NO: 39618 - protein, 152 aa, Zea mays
  misc_feature: Ceres CLONE 1430054-F
  misc_feature (128)..(128): Xaa is any aa, unknown, or other
MVGGSFLLAGVLLVVAATAGAEDGVVQRDRKEDLRWCKQACEWQYGKDTPRKRECESECRERHQQADAGEDGDSGVDAYVSRSGRGECRRQCLRRHEGQPWETQECMRACRPPRLAVDMEQEYRRGTXSAGKCRGEVLAPTPRGTGWESNPA

SEQ ID NO: 39619 - DNA, 646 bp, Zea mays
  misc_feature: Ceres CLONE 1430055-F
  misc_feature: Encodes the peptide sequence at SEQ ID NO. 39620
  misc_feature (260)..(260): n is a, c, t, g, unknown, or other
  misc_feature (314)..(314): n is a, c, t, g, unknown, or other
  misc_feature (375)..(375): n is a, c, t, g, unknown, or other
  misc_feature (396)..(396): n is a, c, t, g, unknown, or other
aagctggagctccccgcggtggcggccgctctagaactagtggatcccccgggctgcaggaattcgcacgagaccattacctagaacatcctaatcgaaaaggaagcttgccgacaactgcactggtctccagggcttcctcgtcttcaacgctgttggcggaggaacaggctctggccttggttccctcctcctggagcgtctgtctgttgactacggcaagagtctaagcttggtttcactgtgtacccatccccccnagtttcgacctcagtggttgagccatacaacagtgtcctgtccacccactcccntccttgagcacactgatgtggctatcctgctgggacaacgaggcatctatgacatctgccngcggtgccttgacattgaacncccacctacaccacctcagagggttgtgtcccagtcatctcatccctgactgcctcccctgagttcgatgtgctcttaacgtggatgtgaatgagttcacgaccacttggtgccctacccgaggaacccactcatgctttcctcctatgctccagtcatccctgctggaaggcctaccaccaacacttttctttgggcaaaatcccaaaaggcccttgaaccatcctccttgatggccaatggccacccc

SEQ ID NO: 39620 - protein, 39 aa, Zea mays
  misc_feature: Ceres CLONE 1430055-F
MLSSYAPVIPAGRPTTNTFLWAKSQKALEPSSLMANGHP

SEQ ID NO: 39621 - DNA, 545 bp, Zea mays
  misc_feature: Ceres CLONE 1430056-F
  misc_feature (364)..(364): n is a, c, t, g, unknown, or other
  misc_feature (394)..(394): n is a, c, t, g, unknown, or other
  misc_feature (545)..(545): n is a, c, t, g, unknown, or other
ggagctccccgcggtggcggccgctctagaactagtggatcccccgggctgcaggaattcgcacgagaccattacctagaacatcctaatagaaaaagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccgggaacggcaggtggcggcgcgcgacctgagagcacagcagcaccgggaccggctcaggcaggcgaccggcagaaaagatngccgggaacaacagctggtggagccggcancggcggcggcgttggcggccaccggaaagggtggctgcacgccgccaaggggcccgggtacccccccccccctgaaggccttggaaaagggccccagggaaaaaattcgtttaagtacccgggggtttaaaagggggccgggaaatataan

SEQ ID NO: 39622 - DNA, 666 bp, Zea mays
  misc_feature: Ceres CLONE 1430061-F
  misc_feature: Encodes the peptide sequence at SEQ ID NO. 39623
  misc_feature (382)..(382): n is a, c, t, g, unknown, or other
aagctggagctccccgcggtggcggccgctctagtactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccnacaatcatcagccctattacagcagttacctttggtgcatttattggcacaaaacatcagggcacaacaactacaacaaacttgtgctagcaaacctttgctgcctactctcagcaacatcaagtttcttccattcaaccaactagcttgcatggactcctgctttctatttgcaaaaaaaacaactaccatttagcccatttatgtgttgccttaccccaagaatttctttccttttacccaattgaaagggtttaaacctccccgcgttttttaaccgaaaa

SEQ ID NO: 39623 - protein, 139 aa, Zea mays
  misc_feature: Ceres CLONE 1430061-F
  misc_feature (75)..(75): Xaa is any aa, unknown, or other
MAAKIFCLLMLLGLSASAATATIFPQCSQAPIASLLPSYLSPAVSSVCENPILQPYRIQQAIAAGILPLSPLFLXQSSALLQQLPLVHLLAQNIRAQQLQQTCASKPLLPTLSNIKFLPFNQLACMDSCFLFAKKTTTI

SEQ ID NO: 39624 - DNA, 661 bp, Zea mays
  misc_feature: Ceres CLONE 1430062-F
  misc_feature: Translation starting site: 229
  misc_feature: SWISSPROT Homolog: EC 3.6.3.14 H(+)-transporting two-sector ATPase
  misc_feature (346)..(346): n is a, c, t, g, unknown, or other
  misc_feature (347)..(347): n is a, c, t, g, unknown, or other
  misc_feature (535)..(535): n is a, c, t, g, unknown, or other
  misc_feature (567)..(567): n is a, c, t, g, unknown, or other
  misc_feature (575)..(575): n is a, c, t, g, unknown, or other
aagctggagctccccgcggtggcggccgctctagaactagtggatcccccgggctgcaggaattcgcacgagaccattacctagaacatcctaatcgaaaagcatcttgcctgcccacccaagcttccctttcgttcctcctcgccccagcgacgcggcctcccgtagaccgagcaaggcaacccaccactgagaggcacgcagaggagcaggaagccggagaccaagatgtcgtcggtgttcagcggcgatgagacggcccccttcttcgggtttctcggcgccgccgccgccctcgtcttctcatgcatgggcgcagcgtacgggaccgcgaaagagcgcgtcnngcgtgcgtcaatgggtgtgatgcggccggagctcgtcatgaagtccatcgtgcccgtggtcatgggctggtgtgctcggtatctacgggctcatcatcgccgtcatcatcagcactgggatcacccccaaggccaagccctactacctttttgatggctacgctcacctttctccgggcttgcctgtngccttgctgggcttgcacctggcatggccatncggatttngtggtgatgctggagtcagggcaaatgcacacaccccgaagctttttggggcataatcctcatcctcattttccaaaagcgcttgt

SEQ ID NO: 39625 - DNA, 617 bp, Zea mays
  misc_feature: Ceres CLONE 1430066-F
  misc_feature (200)..(200): n is a, c, t, g, unknown, or other
  misc_feature (235)..(235): n is a, c, t, g, unknown, or other
  misc_feature (257)..(257): n is a, c, t, g, unknown, or other
ggagctccccgcggtggcggccgctctagaactagtggatcccccgggctgcaggaattcgcacgagaccattacctagaacatcctaatcgaaaaacccccacaagcagaaggatccgggcggccaccgagagtcactggaagaagctcgtccggcgccccgcgacgagacgacggcctcctctccgctccgctgaagncgacctccccgctgacagcgtggcgggccttgtancagaggggtgcggaggcccccnactgttcgcgggatgagcttcgggcgggagccagcttccccttccattttaggggggccaaaaaaaagacgcgcttttttctatttcgggaaaaacctttgggggggggcccgggggcccccaaaggccccccttgtggggccccccaggtggggggaaaaaaaccccccgggggtctaacaaaaagaaaaaaaccccccccccccctcataaaaaaaaaaaaaaggtgggcccccccccccccccttttaaaaaaaaaaccggggtgggggggggggggccccccccccccccccgcgggggggggggggggtggttttttttgaaggggccccccccaccaacaaaaaaaaaaaaaaa

SEQ ID NO: 39626 - DNA, 716 bp, Zea mays
  misc_feature: Ceres CLONE 1430071-F
  misc_feature (662)..(662): n is a, c, t, g, unknown, or other
aagctggagctccccgcggtggcggccgctctataactagtggatcccccgggctgcaggaattcgcacgagaccattacctataacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttctccaacaatcatcagccctattacagcagtttacttttggtgcatttattggcacaaaaaatcaggggacaacaactaccaaaaatttgggctagcaaaactttggttgccaacttcttaaaaaaaaaaagtttccttccctttcaaaccaaataaacttggcatggaaacccccccctctttattttgccaaacaaaaaccaaataaccttttttccccggtttttttggtgggcccccccccgaaaaatttttttttccttttaacacacaaaaaaaaaagantttttaacaccccccgccctttttttttagggggggaaaaaaaaattttctctc

SEQ ID NO: 39627 - DNA, 676 bp, Zea mays
  misc_feature: Ceres CLONE 1430072-F
  misc_feature: Encodes the peptide sequence at SEQ ID NO. 39628
  misc_feature (312)..(312): n is a, c, t, g, unknown, or other
aagctggagctccccgcggtggcggccgctctagaactagtggatcccccgggctgcaggaattcgcacgagaccattacctagaacatcctaatcgaaaaattctatctcattcccaattcctcatctgcttcgcttccccccaaatcgaatcctcatcgctccgtctatatggcgactctaaccatgcagccgatcggtcccacccctgctccggctgcgcagcaagacccgagcaagggagagaatcctcctaccgtggatggtagcgatctgggtgacatcgactcgggctggggtatcctcaagaanctcgatgtcgtttccgccgatttggcaaccgccgccgtctggtgcggtcagcgtctaggctcctctaccattcctagctgggcacggtgggttcctcgaagtgtggtttaaccgctcctggccgtctacaacagaattaggcatctccaaaaccaacggtgggattcctggaaaatgctgtgggaggtgtggagcgatttagctgaaataacaaaaaagctagctgtgaaatgtggcctaaacaacttccttgaggatgggtctctgcaaaaagcattgggaagaggtgaaacactttcctgaagtaatggattgataatcccgaaaaaagtttaaacctctccctaaaaaagatcaacaaggt

SEQ ID NO: 39628 - protein, 83 aa, Zea mays
  misc_feature: Ceres CLONE 1430072-F
  misc_feature (47)..(47): Xaa is any aa, unknown, or other
MATLTMQPIGPTPAPAAQQDPSKGENPPTVDGSDLGDIDSGWGILKXLDVVSADLATAAVWCGQRLGSSTIPSWARWVPRSVV

SEQ ID NO: 39629 - DNA, 665 bp, Zea mays
  misc_feature: Ceres CLONE 1430076-F
  misc_feature: Encodes the peptide sequence at SEQ ID NO. 39630
tggagctccccgcggtggcggccgctctagaactagtggatcccccgggctgcaggaattcgcacgagaccattacctagaacatcctaatcgaaaaagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcggacgcgccacctggagccactgttcgccgcgccctccgcatctccgacctctacatctccatccgcggaagcagaccacctccaatccttctttttcacgcagtcattgcttgcctccttagcccaactgttggtaccagaggttcatgtttcatcataaggaatgaacagtagtcgacaaatggaactccactacataaacactggatttccatacacaatcaccgagagcttcatggatttctttgagggtctcacttttgctcatgctgactttgctctcacggatggctttcaggatcagggtaatccatactgggaaatgatgcatacaaactcgtacaaatatggatactctgggtctg

SEQ ID NO: 39630 - protein, 67 aa, Zea mays
  misc_feature: Ceres CLONE 1430076-F
MNSSRQMELHYINTGFPYTITESFMDFFEGLTFAHADFALTDGFQDQGNPYWEMMHTNSYKYGYSGS

SEQ ID NO: 39631 - DNA, 726 bp, Zea mays
  misc_feature: Ceres CLONE 1430078-F
  misc_feature: Translation starting site: 385
  misc_feature (495)..(495): n is a, c, t, g, unknown, or other
aagctggagctccccgcggtggcggccgctctagaactagtggatcccccgggctgcaggaattcgcacgagaccattacctagaacatcctaatcgaaaaagaccttctttcggtcccgtcctttcccctgcgcgccgcgagtgaattccggagtccccaatctatccgacgccacacgaaacgaaacacaagagaagagagaagagaatagagagaaggtcgaagggctagacccggtcccccaattccaattcgcccctctcgcggccggcctcgcgagacgccgattcggatcccatctcctgctcagagcctcgattcgaccggcgggggcgacgattcgaccgggtcggtagccaggcagaggcagcggaaggagaggatgagcttccaggacctggaggcggggcacgtccgcggggcgccgctcggcggcggccggaggaacggcaggggccccgcgggggcggggggcgccggcgccggcgcgtcncaggccgtggcgtcgggcgtcttccaaatcacaccgcggttggcacgtttcagcgcctcgtcaacacgctcgggacgcccaaagaatacccccgaccctccgcgacagggatactaaaaacacggcaacacctaaccccaacttgtgaagggaaacatccgacaagcttaaacaagctaggcgaggcggaatcatcgcgtttaaagtcagcgcctaccaaaaaagattggc

SEQ ID NO: 39632 - DNA, 727 bp, Zea mays
  misc_feature: Ceres CLONE 1430081-F
  misc_feature (727)..(727): n is a, c, t, g, unknown, or other
agctccccgcggtggcggccgctctataactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccatggctccagagccgcccttcaggtcggcttccacaagctcgccgccgcggtcggcgtcgccctcggacccatgagaatgcaaggtgggcatattacaatggggatactccgagagagtcgaaggaggattttaacaagagacaatggtgggaggtaagtgctgccactggcaaaagctaaacagcttgaataaaagagttttgggtcctaagctgaagaagcacatggcagtattgaaatggatcatccttgattaagattagcaagctttgctaagggtgaagggcgcagggtgtctgagggttaaagggtggttattgatgggaggaacatccgagaaggtttccttgacccgtgggtgaaaaaaattgagagcttttggggggggaaaaaaccccaaaaaan

SEQ ID NO: 39633 - DNA, 645 bp, Zea mays
  misc_feature: Ceres CLONE 1430083-F
  misc_feature: Encodes the peptide sequence at SEQ ID NO. 39634
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgccctcatgacgtccgccgccgtctccaccagggtggagaaacagaaccatttgctcctccgagggaggtagatgggcgggntacacattcatgccatctcacagaatgaattttcagtcacctgatgatgggctaaaaatatatcttgacccttctcagccagtcaagagggttggcgcccaaggatttcctcctggacccggatttgaagatttcttgatgaatttagggcctcaaaaaacggcccagggaatcccccaaaaattattttgttgtttggttggaaaaactttttccgggaaaaccttctccaacaacccaaaaatttgtttta

SEQ ID NO: 39634 - protein, 52 aa, Zea mays
  misc_feature: Ceres CLONE 1430083-F
MALRLHDVALCLSPPLAARRRSGGSFVAVALMTSAAVSTRVEKQNHLLLRGR

SEQ ID NO: 39635 - DNA, 674 bp, Zea mays
  misc_feature: Ceres CLONE 1430086-F
  misc_feature: Encodes the peptide sequence at SEQ ID NO. 39636
  misc_feature (403)..(403): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtgccactacggaaaggagcgccccgcggaggagggatgcnagagcgagtgccccgagcggcaccagcaagctgacgcggggcgaggacggcgacagccgcgtgaacccctacgtcctccgcttcggggagggcgagtgcccgccccagtgcctgccccgccaccaggggcagccgtgggagacccaggaatgcatgaggcggtgcccgccccgcggactggccgtccacatggaacaagagtaccgtcccggcaacaaaacgccgggcaagtgccgggagaagtgccacccccccacccggggggactggg

SEQ ID NO: 39636 - protein, 153 aa, Zea mays
  misc_feature: Ceres CLONE 1430086-F
  misc_feature (64)..(64): Xaa is any aa, unknown, or other
MGKGSVGASWWAFLLLAGVLLVVAATAGAEDGVVERDRKEDLRWCKQACECHYGKERPAEEGCXSECPERHQQADAGRGRRQPREPLRPPLRGGRVPAPVPAPPPGAAVGDPGMHEAVPAPRTGRPHGTRVPSRQQNAGQVPGEVPPPHPGGL

SEQ ID NO: 39637 - DNA, 667 bp, Zea mays
  misc_feature: Ceres CLONE 1430089-F
  misc_feature: Encodes the peptide sequence at SEQ ID NO. 39638
  misc_feature (418)..(418): n is a, c, t, g, unknown, or other
aaagctggagctccccgcggtggcggccgctctagaactagtggatcccccgggctgcaggaattcgcacgagaccattacctagaacatcctaatcgaaaacccgaatcagatcccaccgcccgccggagcgcggaaccctgcccccggccgccatggacatgagcgatgcggagcggctgttcttcttcgagatggcctgcaacaactccgaggtcgcgtacgagcagaaccccaacgacgccgacaacttgacgcgatggggcggagcgctgctggagctatcgcagctgcgtaacggccccgacagcttcaagctccctccagatgcggaagcccagctggaggaggcactgcaaattgatcccaacaagtctgatgcactctggtgcttgaaaaatgctcagacttctcatgnattcttcactccagacactgcaattgcaaatgagttctttgcgaaggcaactgaatgtttccagaaagctgctgatgtggaacctgcaatgagctgtacaggaagtcattagacttgtcagcgaaggcacctgaactgcactcggagatccacagcaattggcttctcaggcggcaacacaagcttcctcaccctcaaatccaacgcaatccaggaagaagaagaagaaggccccgacttctggtacga

SEQ ID NO: 39638 - protein, 124 aa, Zea mays
  misc_feature: Ceres CLONE 1430089-F
  misc_feature (6)..(123): Pfam Name: TOM20_plant Pfam Description: Plant specific mitochondrial import receptor subunit TOM20
  misc_feature (88)..(88): Xaa is any aa, unknown, or other
MDMSDAERLFFFEMACNNSEVAYEQNPNDADNLTRWGGALLELSQLRNGPDSFKLPPDAEAQLEEALQIDPNKSDALWCLKNAQTSHXFFTPDTAIANEFFAKATECFQKAADVEPAMSCTGSH

SEQ ID NO: 39639 - DNA, 705 bp, Zea mays
  misc_feature: Ceres CLONE 1430098-F
  misc_feature: Encodes the peptide sequence at SEQ ID NO. 39640
  misc_feature (705)..(705): n is a, c, t, g, unknown, or other
agctccccgcggtggcggccgctctatactagtggatcccccgggctgcaggaattcgcacgagaccattacctagaacatcctaatcaaaactaacgctgtccgccgccacctctcctccggcatcgacgaggcgaaaccctagcgcccgagtccctctccctgctcccacaacccatggcggcggatatggcgtacgcgccgccgatgaaggctggcaaggccgggttcgaggctggcatgatggatccacagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccagggaagtctcccctgtgggagaaggtacaaaccctgtgatcgctttgagatgaggattcccaagagggtgatcgatctcgtcagaaccccagaactttgtcaagcagatccccccaacccccattgaacccaggggtccagtttaaggtgaccttccaggggccccttaaatagggggcccttattatttcaaaaagggttccttgggaaacagggaatttttccaatttccacgggggagaaacttttggttaaacagagggaaaacccccggttttttctcttatcccaaatgttttaaaaan

SEQ ID NO: 39640 - protein, 91 aa, Zea mays
  misc_feature: Ceres CLONE 1430098-F
  misc_feature (28)..(88): Pfam Name: Ribosomal_S10 Pfam Description: Ribosomal protein S10p/S20e
MAADMAYAPPMKAGKAGFEAGMMDPQHRIRITLSSKSVKNLEKVCGDLVKGAKGKELKVKGPVRMPTKVLHITTREVSPVGEGTNPVIALR

SEQ ID NO: 39641 - DNA, 625 bp, Zea mays
  misc_feature: Ceres CLONE 1430099-F
  misc_feature: Encodes the peptide sequence at SEQ ID NO. 39642
  misc_feature (314)..(314): n is a, c, t, g, unknown, or other
  misc_feature (391)..(391): n is a, c, t, g, unknown, or other
aagctggagctccccgcggtggcggccgctctagaactagtggatcccccgggctgcaggaattcgcacgagaccattacctagaacatcctaatcgaaaaacccttctcgctcggttgctcgggagctttccccttcctgttcctgaagcttccgacatccgaccgcctcctcctcctcgttctactcgccgccccttctagaatcatccagaggcgtgccggtgaaacgcgagagcggtgaagcatggcgatgcagacgggggtcgcgacctccaagtcctcatcctcgtcggtgcagggatgacgggctcnatcctgctgcggaatggccgctatctgatgtggtgggagaactccagagattatgagggttggaaacgagggacttnctccgggtcctatgacatggcactaatcaagctcagattcggatttaccccagaaattcgagattttgaatttgtcaaagcccattacccatactggaagtgcgaaatcctgacccggggggggattttttcctcctaaattactgccccaacaaaattttggaacaaaggggtttttccacccgggggggaagggggttccccccccccaaaggtgtggtgtttgcccaaaac

SEQ ID NO: 39642 - protein, 75 aa, Zea mays
  misc_feature: Ceres CLONE 1430099-F
  misc_feature (30)..(30): Xaa is any aa, unknown, or other
MTGSILLRNGRYLMWWENSRDYEGWKRGTXSGSYDMALIKLRFGFTPEIRDFEFVKAHYPYWKCEILTRGGIFSS

SEQ ID NO: 39643 - DNA, 704 bp, Zea mays
  misc_feature: Ceres CLONE 1430100-F
  misc_feature (8)..(8): n is a, c, t, g, unknown, or other
  misc_feature (13)..(13): n is a, c, t, g, unknown, or other
  misc_feature (16)..(16): n is a, c, t, g, unknown, or other
  misc_feature (19)..(19): n is a, c, t, g, unknown, or other
gggggggnggggnccnccnccacggcagcccggcgcgccgacaccggaaacagcacccaaaactggagctccccgcggtggcggccgctctagaactagtggatcccccgggctgcaggaattcgcacgagaccattacctagaacatcctaatcgaaaaatgatggacaaggtacaccatgatagtagaattttttttacaccctggttatcttgttttaattcatcctttctgtgctccaattattttggtgaatcttagcatagaacttgaccttctattattttgtatgtttggtttgcatgggataactggcatgggatatatttatgaacattgatatcatttttatgcttactcacatgggataatctgatcttctaactcaagatatttttattttggtaatctgatcttctaactcaagtttgcattcagtttagactttaggttatggtagtcataacaaacttgaaaagacatattaacaaggaaagatcatattaacagttcatgttacatttgcagatatggacctcggggggttttctccacattaggaaagctggaagagccttctttgaactcggatttttttgctaacagtggctgttatggcggaaacaaagttttctgtttgttattgtaccaacaagttaacatgttaaacacgtacatttatccatagcttgaagtaccgggg

SEQ ID NO: 39644 - DNA, 667 bp, Zea mays
  misc_feature: Ceres CLONE 1430101-F
  misc_feature: Encodes the peptide sequence at SEQ ID NO. 39645
  misc_feature (42)..(42): n is a, c, t, g, unknown, or other
aaagctggagctccaccgcggtgggcggccgctctagaactnagtggatcccccgggctgcaggaattcgcacgagaccattacctagaacatcctaatcgaaaagaggcctcccgtcgcggtggtcgctttcggccctggaccccgctgccggaatcgaatctcctcccctcctttctcctccgacctcccccttcaccccctccgcggctccgccccgacccgtgacgcctcgcttcgcacccctctcgcatctccgccgcatctccgccgcgatcctcccgactagccgcgactgcctcccctccagcggccaggcagaggatggagggggcaggcaaggatggcaacccgttgaggaattatcggattggcaagactctcggaattggctcattcgggaaggtgaaaattacggagcatatcagcactggacacaaggtggcaatcaagattctcacccgccgtaaaatcagaggcatggagatggaagagaaagttaaaagagagattaggatattgaggttatttatgcatccactttttacccgcctctatgaggtaatagaccccccggctgaattttatggtggttatggaatattgttaagggggggggaaattttttgattacatttgttaaaaaaagaaggcctccaaaaaggaa

SEQ ID NO: 39645 - protein, 101 aa, Zea mays
  misc_feature: Ceres CLONE 1430101-F
  misc_feature: SWISSPROT Homolog: EC 2.7.11.1 Non-specific serine/threonine protein kinase
MEGAGKDGNPLRNYRIGKTLGIGSFGKVKITEHISTGHKVAIKILTRRKIRGMEMEEKVKREIRILRLFMHPLFTRLYEVIDPPAEFYGGYGILLRGGEIF

SEQ ID NO: 39646 - DNA, 720 bp, Zea mays
  misc_feature: Ceres CLONE 1430106-F
  misc_feature: Encodes the peptide sequence at SEQ ID NO. 39647
  misc_feature (637)..(637): n is a, c, t, g, unknown, or other
agctccccgcggtggcggccgctctagaactagtggatcccccgggctgcaggaattcgcacgagaccattacctagaacatcctaatcgaaaaccttgtctcaccaacgtcgcagcgccgtggccctctgagccctctctcgtcttcttccccaccccaccagtgacccacgcgttcctcagatcagatcggcaaggccaatccgaaatctcgagctttcgcgccggcgaccacagcaaagaggaggccacagcacgacagcgccccagggttcctactctcgtcgcagcggcagcagtgaggggaagatgtcgtcggtgttcagcggcgatgagaccgcccccttcttcggcttccttggcgccgccgccgctctcgttttctcatgcatgggggcggcgtacgggacggccaagagtggcgtcggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaagccatactacctctttgacggctatgcccacctgtcgtccggccttgcctgtggtcttgctgggcttgctgcangcatggccattggcatcgttggtgatgctggtgtcagggcgaacgctcagcagccaaagctgtttgtgggcatgatcctcatc

SEQ ID NO: 39647 - protein, 137 aa, Zea mays
  misc_feature: Ceres CLONE 1430106-F
  misc_feature (14)..(79): Pfam Name: ATP-synt_C Pfam Description: ATP synthase subunit C
  misc_feature (93)..(137): Pfam Name: ATP-synt_C Pfam Description: ATP synthase subunit C
  misc_feature: SWISSPROT Homolog: EC 3.6.3.14 H(+)-transporting two-sector ATPase
  misc_feature (110)..(110): Xaa is any aa, unknown, or other
MSSVFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAXMAIGIVGDAGVRANAQQPKLFVGMILI

SEQ ID NO: 39648 - DNA, 650 bp, Zea mays
  misc_feature: Ceres CLONE 1430109-F
  misc_feature: Translation starting site: 146
ctccccgcggtggcggccgctctagaactagtggatcccccgggctgcaggaattcgcacgagaccattacctagaacatcctaatcgaaaatcctctcgctcgccaggagaagcagccgccgttgctgctgccgcgtccacagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtctttgagttgggtctgaccaactatgcagctgcctactgcactggacttctgttggctcgccatgtgctaaagatccgtggttgggataaggagtatgagggcaatgttgaggccactggtgaggacttctctgtttgaccagctaataaaaggaggcatttcggggcccccctgggaagttggccttttccgggcctccaaccgggaaccggtgtttttgggccctcaagggaacctttt

SEQ ID NO: 39649 - DNA, 731 bp, Zea mays
  misc_feature: Ceres CLONE 1430110-F
  misc_feature: Encodes the peptide sequence at SEQ ID NO. 39650
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (22)..(22): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (96)..(96): n is a, c, t, g, unknown, or other
ngggggtggannnngggggggntgtttgtgtgtgttnnggggggnttttgcaatgtgtcaaaatggtggctcaccgcggtggcggccgctctatancagtggatcccccgggctgcaggaattcgcacgagaccattacctagaacatcctaatcgaaaagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgacaagtatgacattggaacgggctttgggcatttcgcaattgctaatgatgacatgtaccagttaacctgagaatatcaagatccaggggtgggtgagatcaccccgcggaacctagtacctgtcgaaagggaggatcccactgattattgggcttccccaccagggatccctggaggggcttaccatgattagggggccttaataccaagaagc

SEQ ID NO: 39650 - protein, 108 aa, Zea mays
  misc_feature: Ceres CLONE 1430110-F
  misc_feature: SWISSPROT Homolog: EC 4.4.1.5 Lactoylglutathione lyase
MATGSEASKAAEAVVDWHKHDSKRMLHAVYRVGDLDRTIKYYTECFGMKLLRKRDVPDEKYTNAFLGFGPENTNFAVELTYNYGVDKYDIGTGFGHFAIANDDMYQLT

SEQ ID NO: 39651 - DNA, 636 bp, Zea mays
  misc_feature: Ceres CLONE 1430113-F
  misc_feature: Encodes the peptide sequence at SEQ ID NO. 39652
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggcccccgtggaggcgaagcaggcgctctactcgagggacctcgctcgcaacctgcgcttcgcctccaacttcgacctcttcaaggctgctgcggccgactggcgcgacacgctcttctg

SEQ ID NO: 39652 - protein, 163 aa, Zea mays
  misc_feature: Ceres CLONE 1430113-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPRGGEAGALLEGPRSQPALRLQLRPLQGCCGRLARHALL

SEQ ID NO: 39653 - DNA, 690 bp, Zea mays
  misc_feature: Ceres CLONE 1430117-F
  misc_feature: Encodes the peptide sequence at SEQ ID NO. 39654
  misc_feature (639)..(639): n is a, c, t, g, unknown, or other
  misc_feature (690)..(690): n is a, c, t, g, unknown, or other
cgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtaccggtcgcgcagcgagagcgcgggcaagtgcccgggagagtgcgagcgcccacaccgcgggnactggtggggagagcagcccttcctgatggactcaaaacccggggggcggn

SEQ ID NO: 39654 - protein, 168 aa, Zea mays
  misc_feature: Ceres CLONE 1430117-F
  misc_feature (152)..(152): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYRSRSESAGKCPGECERPHRGXWWGEQPFLMDSKPGGR

SEQ ID NO: 39655 - DNA, 652 bp, Zea mays
  misc_feature: Ceres CLONE 1430124-F
  misc_feature: Encodes the peptide sequence at SEQ ID NO. 39656
atagctggagctccccgcggtggcggccgctctagaactagtggatcccccgggctgcaggaattcgcacgagaccattacctagaacatcctaatcgaaaaagattagtcacactcttcgcaagcacacaaaaaaaaaaaacccccaaatagcgtaaggataagcctcgccggcgacgaaatcagggtttcatcgaacaagaagatggctcacgcttgcgtctccacatcagcttcctctctcaggtttacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggtccatcagagatgatttacaagtcccttcttcgccgtattttcctgtgtacgctcaaggacaaggaccacctcctatggtgcaagagcgtttccagagtatcataagccagctcttccaatataggattattcgttgtggtggtgctgtggatgatgatatggccaacataatcgtagctcagcttctttacctcgatgctgttgatcctactaag

SEQ ID NO: 39656 - protein, 47 aa, Zea mays
  misc_feature: Ceres CLONE 1430124-F
  misc_feature: SWISSPROT Homolog: EC 3.4.21.92 Endopeptidase Clp
MVQERFQSIISQLFQYRIIRCGGAVDDDMANIIVAQLLYLDAVDPTK

SEQ ID NO: 39657 - DNA, 711 bp, Zea mays
  misc_feature: Ceres CLONE 1430131-F
  misc_feature: Encodes the peptide sequence at SEQ ID NO. 39658
  misc_feature (617)..(617): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatccaaaaacacaaacaagatcttgcattgttcgttgctcgatcgttgcatgtaatggacaaccctgctccgagtatcgtagtgccccccatcgcacgcacctgtatcagcgaacttcagcaaactccccttccgcaacctgtacatccgacggacgggtccacacagaaggcaaatggtgactgaggaaggaagaagaggctctagtgatcagacatgctacatgaggtacgttagtgacttccccgtctaccatagccgtggctccgacaccgacctgatggctcgcgtgcagggcgtcacaaccacgttcggtaactccaaccatttcttcaccgtctccttcaaggctggcatgctaaaaggctccacgctccttaccgaaggagtggtgacggatggatccgttgaatgggcaatctacggcgggaccggagagtttgctatggccagaggtgtcgtcaatataaggtaccttgcctatagggactgctccagcgacactgacgagatcagcatgcangttctctgcccagtgtttggctcatcacagcaactatacnagcaggcacgtgctgtactgtatatactgtcgatagacataacagacagtagat

SEQ ID NO: 39658 - protein, 147 aa, Zea mays
  misc_feature: Ceres CLONE 1430131-F
  misc_feature (116)..(116): Xaa is any aa, unknown, or other
  misc_feature (130)..(130): Xaa is any aa, unknown, or other
MVTEEGRRGSSDQTCYMRYVSDFPVYHSRGSDTDLMARVQGVTTTFGNSNHFFTVSFKAGMLKGSTLLTEGVVTDGSVEWAIYGGTGEFAMARGVVNIRYLAYRDCSSDTDEISMXVLCPVFGSSQQLYXQARAVLYILSIDITDSR

SEQ ID NO: 39659 - DNA, 679 bp, Zea mays
  misc_feature: Ceres CLONE 1430134-F
  misc_feature (443)..(443): n is a, c, t, g, unknown, or other
aagctggagctccccgcggtggcggccgctctagaactagtggatcccccgggctgcaggaattcgcacgagaccattacctagaacatcctaatcgaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccgaggagcacaccgtccccacccccatgtttacccaccagttccctctgacggccgccgtgctccgatgaagctgagcgtgcntcgtatcccgcgctcccactcctttctcgtcgccttcctctactgggtctacgtcttctcatgaacgcatcgcccctctccaactgctgatcctttcgcgtctctccctctctcctttcctctgagatagtctttcaaatccatctctaggggtcctggtttttcccattcttccccccacccaaccccccaacaaaaaagaatcaaatcccaaaaagaaaaaaattcattgtctt

SEQ ID NO: 39660 - DNA, 697 bp, Zea mays
  misc_feature: Ceres CLONE 1430136-F
  misc_feature: Encodes the peptide sequence at SEQ ID NO. 39661
aagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaagatgttggccattacggtggttctttacaggtgacaaaaggtttggctgatacgtttggagacctttcgagtctggacacccctattttgcgagactcgtttactggcatgggagttggagcgggaatgaaaaggctgaggccccgtcttgaaggcatgaacattgggattcctgctcctttgctaacaccagatctcaaaataactgtggcatgcttcattacacttccggcgggccagttcaaaatccaccttggggacccggtggcccccggggggttgggccgtcaacctga

SEQ ID NO: 39661 - protein, 186 aa, Zea mays
  misc_feature: Ceres CLONE 1430136-F
  misc_feature: SWISSPROT Homolog: EC 1.2.4.1 Pyruvate dehydrogenase (acetyl-transferring)
MATAFSLRAAAPATAPRAVSRSTSAARVVPVASALAGRGRLVARAAVTAKADVPSSTSDGHEVLLFEALREALMEEMELDPTVCVFGEDVGHYGGSLQVTKGLADTFGDLSSLDTPILRDSFTGMGVGAGMKRLRPRLEGMNIGIPAPLLTPDLKITVACFITLPAGQFKIHLGDPVAPGGLGRQP

SEQ ID NO: 39662 - DNA, 733 bp, Zea mays
  misc_feature: Ceres CLONE 1430141-F
  misc_feature: Translation starting site: 257
  misc_feature (581)..(581): n is a, c, t, g, unknown, or other
aagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtctcagcccgccgtggcgccggcgtccacggagaggcaggcgcccgccgcggcgttgcaggggttcctgtgcctggaggaggtggacgggaggcggtggagctacgtggtggacggtggggccgcgaaggggaggagcaggggcggggccgtccccgctggggcctccttcagggccgtgccgctgcagtcgccgcttcatcctgccgaggaaataaggnattcataagatcatatgtggggccggaagggttccagacagggttactccttcatatgtaccttacatgacccggagggctctgaagcatttctttgttggaacgaatggagtgtttacaacaaaaagcccgtgcttatcttgagggacgcc

SEQ ID NO: 39663 - DNA, 686 bp, Zea mays
  misc_feature: Ceres CLONE 1430142-F
  misc_feature: Translation starting site: 129
  misc_feature: SWISSPROT Homolog: EC 1.15.1.1 Superoxide dismutase
  misc_feature (573)..(573): n is a, c, t, g, unknown, or other
  misc_feature (574)..(574): n is a, c, t, g, unknown, or other
ctggagctccccgcggtggcggccgctctagaactagtggatcccccgggctgcaggaattcgcacgagaccattacctagaacatcctaatcgaaaaaggagatacagcgagcgagcgaccaaagccatggctctccgcaccctggcatcgaagaaggtcctatccttcccgttcggcggcgcgggccggccgttggcggcggcggcgtctgcgaggggggtgacgacggtcacactccccgacctctcctacgacttcatcgcgctggaaccggccatctcgggggagatcatgcgcttgcaccaccaaaagaccacgccacctacgtcgccaactacaacaaggcgctggagcagcttgacactgccgtctccaagggcgacgcctccgctgtcgtccagctgcagggcgcccatcaagtcacggcggtggtcatgtgaacccattcatcttctggaagaacctcaggcccattagcgaaggtggcgggggagccgctcatgggaaacttggctgggcccatcgatgaggattttggttcgttggaggcacttgtaagaaaatgaatgcnnaaggcgctcctttaaagggtccgggagggggggggttaattttggaataaaaggcaaaaaaactttcctttaaacacacccttaaccgggtcccctggggaacaaaggggga

SEQ ID NO: 39664 - DNA, 737 bp, Zea mays
  misc_feature: Ceres CLONE 1430146-F
  misc_feature: Translation starting site: 529
aaagctggagctccccgcggtggcggccgctctagaactagtggatcccccgggctgcaggaattcgcacgagaccattacctagaacatcctaatcaaaaatcaccaccactgggtcttcagaccattagctttatctactccagagcgcacaataacccgatcgacaccatgtagggtgttgatcgttgccctcgctctcctgactctcactgctagcgccacctccacgcataccatcgggggctgcggctgccctccaccgccgcctgttcatctaccgccgccggagcatctgccacctacggttcacctgccaactccggcgcatctcccacctgcggtccacctgccgccgccggtacacctgccaccgacaggacatgcgccgccacaggtacttctgcagccagccgccatgccactaccctactcaatcaccccggccatgaccgcaaccccagccagaaccatgaccttgccaactcccgcatgcgagagcgcgccagctgctggctacctgccgcgatggccacaccccgataccccgccagtgcatcaagttcctcaggcatcactgactgcccaccgagacgccctactgctcgcgtcactgccactagatcgcggacaagtgtcggcagacggttcagcacgtcgacccgcagcaccggtaccagaggatcctctgcttgattccaccctacaatcctgcaaccgcagccgcaaagccggct

SEQ ID NO: 39665 - DNA, 734 bp, Zea mays
  misc_feature: Ceres CLONE 1430148-F
  misc_feature: Encodes the peptide sequence at SEQ ID NO. 39666
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtacggtcgcggcagcgagagcgcgggcaagtgccgggagaagtgcgagcgccaccaccgcggggactggtgggagagcagcgctgcctgatgatgaaaaacccccggaagcggaaagaagagggccgcac

SEQ ID NO: 39666 - protein, 159 aa, Zea mays
  misc_feature: Ceres CLONE 1430148-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYGRGSESAGKCREKCERHHRGDWWESSAA

SEQ ID NO: 39667 - DNA, 699 bp, Zea mays
  misc_feature: Ceres CLONE 1430168-F
  misc_feature: SWISSPROT Homolog: EC 2.1.1.43 Histone-lysine N-methyltransferase
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (406)..(406): n is a, c, t, g, unknown, or other
aaaactggagctccccgcggtggcggccgctctagaactagtggatcccccgggctgcaggaattcgcacgagaccattacctagaacatcctaatcgaaaagtaccatgttcaaaacgaaaagtctgatctgaagccagcagaacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacggtcgcnnntcccgggtncggggggaggaggcgggtggtggtgtaccagagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgccttcgacgactgcgtcgtcaagggcggcgccgccttggaacccagcgagaccgtctccttccagtactccaactccttctcctaccagctcagtgtcgcctccgtcc

SEQ ID NO: 39668 - DNA, 722 bp, Zea mays
  misc_feature: Ceres CLONE 1430171-F
  misc_feature: Encodes the peptide sequence at SEQ ID NO. 39669
ctccccgcggtggcggccgctctagaactagtggatcccccgggctgcaggaattcgcacgagaccattacctagaacatcctaatcgaaaaaggtcattcggtcattccacttccaccaatctgtctcccaatctttcttgctgctccaattcgctctctttactcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgagcggctggaggcactggagggcaaggacgcggtgctcctgcgcgcctacgtcggggacaagcccacttggcgcgacccggcgcacccgtggagggtggaccccaggtttcgggctcaagggcgtgccaacgctgatccgctgggaagatggcgccgccgccgcccgcctcggggacaacgaggggcaccctcagggacaaggttgaccccctcctcctggcctggcggcaactgagtactgacggatcttggttccccgttccgggttccctctgccggagaggggcccatataaccagggactggaattccgttccatccaccttgccgggacccgaaagg

SEQ ID NO: 39669 - protein, 139 aa, Zea mays
  misc_feature: Ceres CLONE 1430171-F
  misc_feature (9)..(132): Pfam Name: DUF953 Pfam Description: Eukaryotic protein of unknown function (DUF953)
MTVEKVDAGLSDFDAHFDRLFASPDAASDGKVKLLLFLADRKPGSSLSWCPDCNVAEPVIYERLEALEGKDAVLLRAYVGDKPTWRDPAHPWRVDPRFRAQGRANADPLGRWRRRRPPRGQRGAPSGTRLTPSSWPGGN

SEQ ID NO: 39670 - DNA, 662 bp, Zea mays
  misc_feature: Ceres CLONE 1430181-F
  misc_feature: Encodes the peptide sequence at SEQ ID NO. 39671
  misc_feature (437)..(437): n is a, c, t, g, unknown, or other
  misc_feature (577)..(577): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (593)..(593): n is a, c, t, g, unknown, or other
  misc_feature (594)..(594): n is a, c, t, g, unknown, or other
  misc_feature (627)..(627): n is a, c, t, g, unknown, or other
  misc_feature (632)..(632): n is a, c, t, g, unknown, or other
  misc_feature (634)..(634): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
aagctggagctccccgcggtggcggccgctctagaactagtggatcccccgggctgcaggaattcgcacgagaccattacctagaacatcctaatcgaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggntccgcgaccactggtcccgcgagcacgcccacctggaccaaatagccaaaccactccagtttggtcccccttccttgccccacaaaggagggaaaagggagaaccctttttttcggggggaaaaagggcccccccccccncggnnnnnnntttttnnttaaaaaaaaaaaaaaaaaaaatttttttcttncccgncncgnnnnaaaaaaaaaaaatttatacccc

SEQ ID NO: 39671 - protein, 93 aa, Zea mays
  misc_feature: Ceres CLONE 1430181-F
  misc_feature (42)..(42): Xaa is any aa, unknown, or other
  misc_feature (90)..(90): Xaa is any aa, unknown, or other
  misc_feature (91)..(91): Xaa is any aa, unknown, or other
  misc_feature (92)..(92): Xaa is any aa, unknown, or other
MSAVAVSSSLNPNAPLFIPAALLQVEDFSPQWWDLITTTAWXRDHWSREHAHLDQIAKPLQFGPPSLPHKGGKRENPFFRGEKGPPPPRXXXF

SEQ ID NO: 39672 - DNA, 684 bp, Zea mays
  misc_feature: Ceres CLONE 1430182-F
  misc_feature: Encodes the peptide sequence at SEQ ID NO. 39673
  misc_feature (653)..(653): n is a, c, t, g, unknown, or other
cgctctagaactagtggatcccccgggctgcaggaattcgcacgagaccattacctagaacatcctaatcgaaaaatttttctaaatctctaaccctagcgtaccgagcttggcgtggcggcggcagtgtcccgggctcccagcggcacagtcgtgcggcacgagcgcagcctctgtgcctaggctgcacctgcacgtcggccggcggcacgcggtggctaataggctggaggcactgtctgagcggctgcccaccaggcactagcaagggagtacccaagtggtccagctcccactatggttctaaccagcaatgtttcggttcagaagaccttgtacgaggttttatctgtgagtgaagacgctacatatgaagaaatccgcgcagcgtacaggtctgccgctctgaacacacaccctgacaaagcgcagacaactctcgagtcatcatccgtgccttccactgagcaacaggaattttctagcgtgcagaaagcatgggaagtcctacgacatcctacatccagagcagattatgacaagcagctgcagtcatccagacagagcatcgagatcatcgcatccgaaatccaagtcggggacatgattgtcgagagcgctgctggtgctctagagctgctgtacccatgcangtgtggcgattattttctcatcactttcggt

SEQ ID NO: 39673 - protein, 129 aa, Zea mays
  misc_feature: Ceres CLONE 1430182-F
  misc_feature (12)..(81): Pfam Name: DnaJ Pfam Description: DnaJ domain
  misc_feature (119)..(119): Xaa is any aa, unknown, or other
MVLTSNVSVQKTLYEVLSVSEDATYEEIRAAYRSAALNTHPDKAQTTLESSSVPSTEQQEFSSVQKAWEVLRHPTSRADYDKQLQSSRQSIEIIASEIQVGDMIVESAAGALELLYPCXCGDYFLITFG

SEQ ID NO: 39674 - DNA, 766 bp, Zea mays
  misc_feature: Ceres CLONE 1430184-F
  misc_feature: Encodes the peptide sequence at SEQ ID NO. 39675
  misc_feature (721)..(721): n is a, c, t, g, unknown, or other
  misc_feature (766)..(766): n is a, c, t, g, unknown, or other
aaagctggagctccccgcggtggcggccgctctagaactagtggatcccccgggctgcaggaattcgcacgagaccattacctagaacatcctaatcgaaaaacggagcaaaacgaaacgcggcagccagcacaacccagcagagcgcgactcgactcgaatcgaatagtcccgtcctttcggttctacctttccctcccgcgccgccgcagccgcctccagggccgcggaaaccctagccacctcgtcagtgccgcgcgccgggtgtctcgccgccgcccgtcactgccgctgacaccgccggagcgatcggatctcgagaccgtcaggagacacgatggaggattgggattctgaagatttccagcccgttgctcctgttgtgaaagtcgagccacttaaaaatcagtgggctgatgaagatgtctatgccgactacataaaagattcatgggaggaagaagatgaagaggagaaacctaagccagctgctgtgcaaaagaccgctacgatggcgtgcggtgagtggccgtgccgagatggtgaattcctagctgggcgcggaggggcgaacaacccgacggtcagctgttggtccctcggccgtcatattggtctgtgagggggggggtggtgggcgggcagggccgggcgcggaggcgggctttgggcggaagggtcccgacacgagcgtagtgtgggacggtcggcgagcccgcanttatcctcgtcttacaagagacggacgcgcagacgaactacatgn

SEQ ID NO: 39675 - protein, 94 aa, Zea mays
  misc_feature: Ceres CLONE 1430184-F
MEDWDSEDFQPVAPVVKVEPLKNQWADEDVYADYIKDSWEEEDEEEKPKPAAVQKTATMACGEWPCRDGEFLAGRGGANNPTVSCWSLGRHIGL

SEQ ID NO: 39676 - DNA, 698 bp, Zea mays
  misc_feature: Ceres CLONE 1430185-F
  misc_feature: Encodes the peptide sequence at SEQ ID NO. 39677
  misc_feature (659)..(659): n is a, c, t, g, unknown, or other
ggcggccgctctagtctagtggatcccccgggctgcaggaattcgcacgagaccattacctagaacatcctaatcgaaaaacacccacgccgtcggatcctcctgccctccccacgtccacctctctccgccgaagaatcggcggcggcggcggcggcggcgagcgccttcccttgtcaaaatccacccggcggcagagcagagcctcgttgctgaggaggggagatggcaggcatgaccgatatgccgatgaggccggcgcggccgggcccgccgatgcagcaccggggccctccgccgatggcgcgcctccgccccgaaccaatcgaccgcgagaagacctgccctctgctgctcagggttttcacaagggttgctggtcaccaccaaaatgaagagttttctgtgagagggaaagaaccaaaggatgaagttcagatttacacatggaaggatgccactctccgtgagcttactgatcttgtgaaagaggttgctcttccagcaaggaaaaggaacgcgaggctttcttttgcatttgtatacccagacaagaatggtcgttttgttgtcagacaggtgggttcgaccttcgcttatggccatggaaagagtgatgatgccaaaactcttgcagagcttgggttccagattggcgnatatctgagcgtcgcgatcatgtaactgcagattggcga

SEQ ID NO: 39677 - protein, 152 aa, Zea mays
  misc_feature: Ceres CLONE 1430185-F
  misc_feature (30)..(151): Pfam Name: SAP18 Pfam Description: Sin3 associated polypeptide p18 (SAP18)
  misc_feature (145)..(145): Xaa is any aa, unknown, or other
MAGMTDMPMRPARPGPPMQHRGPPPMARLRPEPIDREKTCPLLLRVFTRVAGHHQNEEFSVRGKEPKDEVQIYTWKDATLRELTDLVKEVALPARKRNARLSFAFVYPDKNGRFVVRQVGSTFAYGHGKSDDAKTLAELGFQIGXYLSVAIM

SEQ ID NO: 39678 - DNA, 715 bp, Zea mays
  misc_feature: Ceres CLONE 1430194-F
  misc_feature: Encodes the peptide sequence at SEQ ID NO. 39679
aaagctggagctccccgcggtggcggccgctctagaactagtggatcccccgggctgcaggaattcgcacgagaccattacctagaacatcctaatcgaaaaattcgcccgttcgaattctctcgcctcgacctcctcctcacctgcctgctcggctgctcgccagaccaaccacagccgtcggcgctgcagaccgcggcgggcaggatcagcggtgcgtagtctgcccatttcgcgaggaccatataattccaagaccctgatgatggccacaactgcttatatcgatgattcctgttcggaggttattgatcccccgaagactgaggtgctggatgttgctgaactccctggtgaccatactcagaacccaccaaaaccgaatgttgtggtgtctagcagtgtccgtgaacttctggaatgtccagtctgtttgagtgccatgtatccctctattcatcagggctcctatggtcatacattgggttccggatgcaaaccagggtttcatatcgttgtccaacttggaggcttgaatgggtaaacatagggggcttggcccccaaaaaggtgggtggcctcccttgaaacttcccggcaagcacaagggcttggggggcccgggcttttttccctttccccccaactttaaacttgagcccaaggcccaaatagggcccttaagttgcccaaagtcgcggaaatcaagggccac

SEQ ID NO: 39679 - protein, 92 aa, Zea mays
  misc_feature: Ceres CLONE 1430194-F
MATTAYIDDSCSEVIDPPKTEVLDVAELPGDHTQNPPKPNVVVSSSVRELLECPVCLSAMYPSIHQGSYGHTLGSGCKPGFHIVVQLGGLNG

SEQ ID NO: 39680 - DNA, 665 bp, Zea mays
  misc_feature: Ceres CLONE 1430195-F
cgctctattactagtggatcccccgggctgcaggaattcgcacgagaccattacctagaacatcctaatcgaaaaataggaatcatccatcgcgtctgtgctccccctcgcgcaatcctaccgcactcgcctcccgaaatcggccgccacggcgcctcacgccatggctcctgcccagcagctgcagctccctccgcctccggtggtctggcacgccgcctcctcgcccagatccgtccgtggtccgcccctccggcctcgcccagctccaaagctccctcctgctcgcgggcacgcgatctcgccctgggggccatgccctaggccgtcgtctcggctcgcgtccacctcgtccagcgtcacaagtggcgccgccgccggtgtcggctacttcgatctcccgcccgccgtcgactcgtccagcagtacctacgctctgaatccgatcccctcgccggtggcgacggcgtcggctgacccatccccaaactcggcgcgggagcccaagcggaagcgaactggcccgtgcgtcccccgcatcaactcgaaccgaagggacgaccaagcggagtctagactcaagagcaaccgcgacctcccggatctctctccgacccacgcctcgtcaccgtcgtcttctgctgcactgcagcgatggcctcccc

SEQ ID NO: 39681 - DNA, 666 bp, Zea mays
  misc_feature: Ceres CLONE 1430203-F
  misc_feature: Encodes the peptide sequence at SEQ ID NO. 39682
ctataactagtggatcccccgggctgcaggaattcgcacgagaccattacctagaacatcctaattgaaaaattcgcggtttgcctctctgcctgcctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacacacactctgaggaggagctcaaggaggccttccgcgtgttcgacaaggaccagaacggcttcatctctgctgctgaacttcgacatgtcatgaccaacctaggtgagaaactgacggacgaggaggtggatgagatgatccgtgaagccgacgtggaaggggatggccaaatcaactacgaggagttcgtgaaggtgatgatggccacagtgagatgatgtgccctgttttgaaactaggttcctctcttggatggtaagtaccctaggcttaagtgttgggaaggaactgacctggctttttgg

SEQ ID NO: 39682 - protein, 151 aa, Zea mays
  misc_feature: Ceres CLONE 1430203-F
  misc_feature (85)..(113): Pfam Name: efhand Pfam Description: EF hand
  misc_feature (12)..(40): Pfam Name: efhand Pfam Description: EF hand
  misc_feature (121)..(149): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTHSEEELKEAFRVFDKDQNGFISAAELRHVMTNLGEKLTDEEVDEMIREADVEGDGQINYEEFVKVMMATVR

SEQ ID NO: 39683 - DNA, 708 bp, Zea mays
  misc_feature: Ceres CLONE 1430217-F
  misc_feature: Translation starting site: 212
aagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtacggtcgcggcagcgagagcgcgggcaagtgccgggagaggtgcgagcgccaccaccgcggggactggtgggagaggcagcgcgcctgtgtgaaaaaccccggggggg

SEQ ID NO: 39684 - DNA, 835 bp, Zea mays
  misc_feature: Ceres CLONE 1430227-F
  misc_feature: Encodes the peptide sequence at SEQ ID NO. 39685
  misc_feature (22)..(22): n is a, c, t, g, unknown, or other
  misc_feature (26)..(26): n is a, c, t, g, unknown, or other
  misc_feature (30)..(30): n is a, c, t, g, unknown, or other
  misc_feature (31)..(31): n is a, c, t, g, unknown, or other
  misc_feature (46)..(46): n is a, c, t, g, unknown, or other
  misc_feature (47)..(47): n is a, c, t, g, unknown, or other
gggttctcccaaaataaatttntccntttnnattttctccctaaannaaacgcaaaaaaaaactccccgcggtggccgcccctcttttcctataggatcccccgggctgcaggatttcccacgagaccattacctataacatcctaatcgaaaaacagtgcctctcgctcactgactgactgtaataccagagatccaacaacttggtcctgcagctcaagaagagagtttttgtgcatttgggggccgggggcaagagagagagagagagccatggcggcggaccagccgccgcagctgcaggaggagatgaacgacgctgccggaggcggactcaggctgcctccagggttccgcttccacccgagcgacttttagatcgtcagcttctacctcacccacaaggtgctcatcacgactcttcacctgcaccgccatccaccgaggccgacctaaactgagattcgagccatgggcacctcccatacggagggtgaagatggcgcgaagaaaggagcgggtacttttcttccaccctgaaagcgaccgtcatgtgacccggacggggggctgtatggccttaaccgtgggtcaacccgaaggcccgggatgctgggaaaggcgcacctggtcaaattaacaagggaggttctatcaatcccccccccaaaaagaggtaataacagttcctggcccagccaatgaaaggagagacccctcggtgtatcttaccagggagagaaggggcttctcccggcggtttgaccaaagaacaaaactggggcgcccttggcaccaagatcaatgtgctcctaaagggccacgccgcccaccc

SEQ ID NO: 39685 - protein, 34 aa, Zea mays
  misc_feature: Ceres CLONE 1430227-F
MAADQPPQLQEEMNDAAGGGLRLPPGFRFHPSDF

SEQ ID NO: 39686 - DNA, 674 bp, Zea mays
  misc_feature: Ceres CLONE 1430228-F
  misc_feature: Encodes the peptide sequence at SEQ ID NO. 39687
aagctggagctccccgcggtggcggccgctctagaactagtggatcccccgggctgcaggaattcgcacgagaccattacctagaacatcctaatcgaaaaatcacccttattattgagacatacaaggaacatagatcgtggaatccagtaccaacaatagaccaacaatggggagcaagatattttcggtccatatgctcctggctctttctgcatgtgttgctaactccacaaatttccctcgatgctcacgagatcctatagcttcgcttcttcccccataccttgcatcaatgataacttcagtatgtgaaaacccagctcttcaaccctataggctcaaacaagtgatggcagcgagcaacatgccttgatcacccttggtgcaacaatcggcagccctatcgttggtgctgtcattgctacaaacgatgacggcacagcagctgctgcaactcatgctacctgtgatcaaccaagtaggtctggtaaacctttctccctactctcagtaacaccgatttcttccattcaaccaactgtctacattgaaccgtgctgattatttgcaccaacaactattaacgttcagccagctagctactgactactcgcagcaacacaacttcttccattaaccaattggccgctcgtgacaccactgcttatttg

SEQ ID NO: 39687 - protein, 68 aa, Zea mays
  misc_feature: Ceres CLONE 1430228-F
MGSKIFSVHMLLALSACVANSTNFPRCSRDPIASLLPPYLASMITSVCENPALQPYRLKQVMAASNMP

SEQ ID NO: 39688 - DNA, 702 bp, Zea mays
  misc_feature: Ceres CLONE 1430232-F
  misc_feature: Encodes the peptide sequence at SEQ ID NO. 39689
ggcggccgctctagatctagtggatcccccgggctgcaggaattcgcacgagaccattacctagaacatcctaatcggaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggctcccgccccaaccgcgccgccgggtcgggctactggaaggccacgggcgcggacaagcccgtggagcacgggggccggacggcggggatcaagaaggcgctcgtgttctaccacggcaagccgccgcgcggggtcaagacggagtggatcatgcacgagtaccgcctcgccggcgacgcgaagaagtccggcggcggcacgctcaggctggatga

SEQ ID NO: 39689 - protein, 161 aa, Zea mays
  misc_feature: Ceres CLONE 1430232-F
  misc_feature (21)..(147): Pfam Name: NAM Pfam Description: No apical meristem (NAM) protein
MAAVQQQQQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTAGIKKALVFYHGKPPRGVKTEWIMHEYRLAGDAKKSGGGTLRLD

SEQ ID NO: 39690 - DNA, 657 bp, Zea mays
  misc_feature: Ceres CLONE 1430234-F
  misc_feature: Encodes the peptide sequence at SEQ ID NO. 39691
  misc_feature (438)..(438): n is a, c, t, g, unknown, or other
  misc_feature (439)..(439): n is a, c, t, g, unknown, or other
  misc_feature (545)..(545): n is a, c, t, g, unknown, or other
  misc_feature (573)..(573): n is a, c, t, g, unknown, or other
  misc_feature (603)..(603): n is a, c, t, g, unknown, or other
  misc_feature (605)..(605): n is a, c, t, g, unknown, or other
aagctggagctccccgcggtggcggccgctctagaactagtggatcccccgggctgcaggaattcgcacgagaccattacctagaacatcctaatcgaaaaaacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccnngcgtcgcgaagcatgcggcgccacgctgcgccacctcgacctagggaacaaccgggttcgcggagtccaggagctcgcgccactcgccggggtccgggtcgagtcnctcgacctgttccagtgccccgtcaccnagggtcaggggtacagggatgaggtcttcncnctgatccccagctcaagtacctcgatggcgctgacgctgagggcacgagcgt

SEQ ID NO: 39691 - protein, 168 aa, Zea mays
  misc_feature: Ceres CLONE 1430234-F
  misc_feature (96)..(96): Xaa is any aa, unknown, or other
  misc_feature (141)..(141): Xaa is any aa, unknown, or other
  misc_feature (151)..(151): Xaa is any aa, unknown, or other
MAAAAAGEDDAAWERAISAATKSTSAPKTLTLDGAVKSSTGGLPSAALLERFAASLEELSVAGARLSSLAGLPRLPALRRLSLPDNRLSGAAALAXRREACGATLRHLDLGNNRVRGVQELAPLAGVRVESLDLFQCPVTXGQGYRDEVFXLIPSSSTSMALTLRARA

SEQ ID NO: 39692 - DNA, 678 bp, Zea mays
  misc_feature: Ceres CLONE 1430248-F
  misc_feature: Encodes the peptide sequence at SEQ ID NO. 39693
  misc_feature (446)..(446): n is a, c, t, g, unknown, or other
aaagctggagctccccgcggtggcggccgctctagaactagtggatcccccgggctgcaggaattcgcacgagaccattacctagaacatcctaatcgaaaaagttcgccttcccgtctttccctctccccccacacccggtcgtcgtcgtcgcgtcgtgagcgtctgagcgagcgtgcgagagcgagaggggggaacacaaaaccctagcaccgtcgccgacggacgccagagtagagagatggcggtggacgaggtgaattcggtctacgtcggcagcctcccctacgaggccaacgaggagatgcttcgcgacgccttcgggtactacggcaccatcgtctcccgtcaggtgattaatgatcatactatcaaagggcagtgttatgggttttgtactttcactcaccccagagctgctgagcaagcaattgcaggcatggacngcaagaaattaggcaatcgtattattcgagtaaatgaagtgcgtacaagaggtccccgagattttgtcgagatggttttagacgagatccaagaagtatggtagagatccatactggggacagaagggatagggaaacagagctatgatcatgaaagagatcccctaccatgacagggatagtgatagatcccgcgagcatgatagagaaagagattatgagcctgggtgct

SEQ ID NO: 39693 - protein, 102 aa, Zea mays
  misc_feature: Ceres CLONE 1430248-F
  misc_feature (9)..(79): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (69)..(69): Xaa is any aa, unknown, or other
MAVDEVNSVYVGSLPYEANEEMLRDAFGYYGTIVSRQVINDHTIKGQCYGFCTFTHPRAAEQAIAGMDXKKLGNRIIRVNEVRTRGPRDFVEMVLDEIQEVW

SEQ ID NO: 39694 - DNA, 665 bp, Zea mays
  misc_feature: Ceres CLONE 1430249-F
  misc_feature: Encodes the peptide sequence at SEQ ID NO. 39695
gctctagattccgtggatcccccgggctgcaggaattctcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcaacaccgcgccgcccgggcagccgaccacggtagcgtccaaggtgctggacatgggcgcggcggcgatgcagtctttgcgccccgtgaagcatgcgaagcagcacatgtgcacgttcgcgctgtacgcgcacgatccgaaacggcagtggagacgcacactacatctcccgcctcaaccaagactttcctccagtgcgccctctcttactccgagaaagccaaccggcgtttcatgggccgggagaacatcctgtccaggaaaatttttaactggtttccggcggaggaaccaccggttgggggccccccacgcccccacaaaatcaaatcccggcctgggggaacaaccccccccccggggggggggccttccttgaaaaaagggggaaactggagccacagggggcccccccattttcggcaaaaatttctggggcctcccttttacagggggagacaccccccgcgcccccc

SEQ ID NO: 39695 - protein, 146 aa, Zea mays
  misc_feature: Ceres CLONE 1430249-F
  misc_feature (26)..(132): Pfam Name: DUF1264 Pfam Description: Protein of unknown function (DUF1264)
MASSDGKPLPTPASVGGGGGSNTAPPGQPTTVASKVLDMGAAAMQSLRPVKHAKQHMCTFALYAHDPKRQWRRTLHLPPQPRLSSSAPSLTPRKPTGVSWAGRTSCPGKFLTGFRRRNHRLGAPHAPTKSNPGLGEQPPPRGGGLP

SEQ ID NO: 39696 - DNA, 729 bp, Zea mays
  misc_feature: Ceres CLONE 1430252-F
  misc_feature: Encodes the peptide sequence at SEQ ID NO. 39697
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggaatgcatgaggcggtgccgccgccgcggactggccgtcgacatggagcaagagtacggtcgcggcagcgagagcgcgggcaagtgccgggagaggtgcgagcgccaccaccgcggggactggtgggagaggcagcgctgcctgatgaggaaaaaccccccgagggagcggaaaaaaga

SEQ ID NO: 39697 - protein, 171 aa, Zea mays
  misc_feature: Ceres CLONE 1430252-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYGRGSESAGKCRERCERHHRGDWWERQRCLMRKNPPRERKK

SEQ ID NO: 39698 - DNA, 721 bp, Zea mays
  misc_feature: Ceres CLONE 1430265-F
  misc_feature: Encodes the peptide sequence at SEQ ID NO. 39699
aaagctggagctccccgcggtggcggccgctctagaactagtggatcccccgggctgcaggaattcgcacgagaccattacctagaacatcctaatcgaaaatacctagaacatcctaatcgaaaactcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggcctcggcgtcgctgcgctgtccgtgttctcctggatgtacaagtacctgacgggcaagcacccgccgggcgccgaccagctggaccacgccaaggcgaggctggcgtccaaggcccgcgacatcaaggatgcagcacagcaccgcatcgaccaggcgcaggggtcttgagagaagaacacactcgagcggaccgcgcgcgcgtcctcctt

SEQ ID NO: 39699 - protein, 156 aa, Zea mays
  misc_feature: Ceres CLONE 1430265-F
  misc_feature (36)..(146): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLGVAALSVFSWMYKYLTGKHPPGADQLDHAKARLASKARDIKDAAQHRIDQAQGS

SEQ ID NO: 39700 - DNA, 723 bp, Zea mays
  misc_feature: Ceres CLONE 1430269-F
  misc_feature: Encodes the peptide sequence at SEQ ID NO. 39701
  misc_feature (33)..(33): n is a, c, t, g, unknown, or other
agagctggagctccccgcggtggcggccgctcnataactagaggagcccccgggctgcaggatttcccacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgcctccaacttcgacctcttcaaggctgctgcggccgactggcgcgacacgctcttctgcgaggtggctccgaacccgtcgccgcgggaggagctgccggagccactcaggaacttgatgctggagtacggcgccccggttgacaag

SEQ ID NO: 39701 - protein, 192 aa, Zea mays
  misc_feature: Ceres CLONE 1430269-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFASNFDLFKAAAADWRDTLFCEVAPNPSPREELPEPLRNLMLEYGAPVDK

SEQ ID NO: 39702 - DNA, 802 bp, Zea mays
  misc_feature: Ceres CLONE 1430274-F
  misc_feature: Encodes the peptide sequence at SEQ ID NO. 39703
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (42)..(42): n is a, c, t, g, unknown, or other
gccccccccccnncnnnnnnnnnnttagntttgaatgccccnataatatactggactccccgcggtggcggccgctctagtacagaggatcccccgggctgcaggaattcccccgagaccattacctagaacatcctaatcgaaaaaacccattgtgagtctctttgatccctcgccgtctggtctccgtgtgctctcgtcgccgtcgccgtcgccgccgtctgactgaccccctcgcctcccgcggcgacgggtctctggtgctgctgctactgctgccgcgtgcagggctgtgatggcgacgaagaggagcgtgggcaccctcggcgaggcggatctgaaggggaagaaggtgttcgtgcgcgccgacttcaacgtccctctcgacgacgcccagaagatcaccgacgacttttgtatcggcgcctccctccccaccatcgagttcctcctcgagaagggcgccaaggtcatcctcgccagccatctgggtcgtccaaaaggtgtcaccccaaagtacagcttgaagcctcttgttccacgcttggctgagctccttggagttaaagccctgacggcccaccctcgccttggtgaggaagcttagaagttgggctgcccgttttgcccacacggtggagtttctgcttccaggaacaatgtgaggtttctcctccggagggaggagcaggaaggtgaacctgagtgttccgcaacaaaactaccaatttgttgtcagcgcccttaacggtccaactgacgctattgtgggcgatgggccaccatcgagtcttcttggccc

SEQ ID NO: 39703 - protein, 103 aa, Zea mays
  misc_feature: Ceres CLONE 1430274-F
  misc_feature: SWISSPROT Homolog: EC 2.7.2.3 Phosphoglycerate kinase
MATKRSVGTLGEADLKGKKVFVRADFNVPLDDAQKITDDFCIGASLPTIEFLLEKGAKVILASHLGRPKGVTPKYSLKPLVPRLAELLGVKALTAHPRLGEEA

SEQ ID NO: 39704 - DNA, 717 bp, Zea mays
  misc_feature: Ceres CLONE 1430275-F
  misc_feature: Encodes the peptide sequence at SEQ ID NO. 39705
ctccccgcggtggcggccgctctagaactagtggatcccccgggctgcaggaattctctcgagaccatttccttgaactcctaatcaaaaaattctttgttctccgaccctatgctgctgtgctgtcactgcctgtgagtacgggcctccgggcgatcaccggaggactcatctgactgaccacagatacgggagtgttgcacgaaacgatcgtctgtggcatcacaatctccctggtgtccatggatgtctactagacaatttggacctccaaccacccgatgatctggagcgtcatctacatgctcaatgtcttcttggagcttgctcaccgcgccgccttgtgcgcgagaaggtggaccccaccaatgctcagcgcctgtcgaaagccagatgaacacagcacacacaccttgctttcatgcacaccacgcctacatcttcaacactgactgtacctactgcatggcgagggtcgccatggacgctctccccgtcattatgttcaccgaacgcatcaacgtagacgcctgctgcgatctcctcgcctgttctgtttgcctcctagaatttctatccggcgacagcgccaggagcctgccggtgtgccgccacacgttccacctgccgtgcatcaacagttggctgatcctgcactcctcctgccccttgtgcctcctctctgtctaggccgagcccatacctctacactcaata

SEQ ID NO: 39705 - protein, 74 aa, Zea mays
  misc_feature: Ceres CLONE 1430275-F
  misc_feature (29)..(70): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MARVAMDALPVIMFTERINVDACCDLLACSVCLLEFLSGDSARSLPVCRHTFHLPCINSWLILHSSCPLCLLSV

SEQ ID NO: 39706 - DNA, 729 bp, Zea mays
  misc_feature: Ceres CLONE 1430276-F
  misc_feature: Encodes the peptide sequence at SEQ ID NO. 39707
  misc_feature (729)..(729): n is a, c, t, g, unknown, or other
ctccccgcggtggcggccgctctattaactagtggatcccccgggctgcaggaattcgcacgagaccattacctagaacatcctaatcgaaaagggaaaatcataggttctccacgacgcggccatctccgccaccgccagcgccacctgctagggtcaacacccgctctctgcggactgcgtgaagcaccagcggcggccaccgggcaggacgagccccctccccaaacagagaggggcggggatcagtgcgtgcgctcctggtggagggcgtggaagagcttggcaggcggcaagcaggggtttgggaggatggtttcgctctcgacttggttccgctatgccgcacaaaagttcgagtactgcgtttccctctcgttgaagaaatataatgacgtgggccggatcagcagcacacagctaactgatgtgttaaacaaaaatttattccaaggcaagctcacctacgtgtgtccgaccaaaggggaagaagccatggctcccatcgcatctccaactggaggagccgtccttgtcagaaaactcgcaaatttgagccccacgcaagtgtttgtcggggacgttgtgttgttaaaagacccagagaaatctgatgatttaattattcgacgactggctgcccttggaggctatgagatggtctctaatgatgagaaggatgagccgtttgtgcttgagaagaccaatgctgggtcctggcagacaccn

SEQ ID NO: 39707 - protein, 139 aa, Zea mays
  misc_feature: Ceres CLONE 1430276-F
MVSLSTWFRYAAQKFEYCVSLSLKKYNDVGRISSTQLTDVLNKNLFQGKLTYVCPTKGEEAMAPIASPTGGAVLVRKLANLSPTQVFVGDVVLLKDPEKSDDLIIRRLAALGGYEMVSNDEKDEPFVLEKTNAGSWQTP

SEQ ID NO: 39708 - DNA, 640 bp, Zea mays
  misc_feature: Ceres CLONE 1430279-F
  misc_feature: Translation starting site: 295
  misc_feature: SWISSPROT Homolog: EC 2.5.1.47 Cysteine synthase
  misc_feature (207)..(207): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (339)..(339): n is a, c, t, g, unknown, or other
  misc_feature (350)..(350): n is a, c, t, g, unknown, or other
ctggagctccccgcggtggcggccgctctagaactagtggatcccccgggctgcaggaattcgcacgagaccattaactagaacatcctaatcgaaaaatctccagcggcttcttccaaagctccaactccgacgagaaccgccactcctcgaaatctcgaaggattttctgcggcgaaccccttcgtgacgtgacccaatgggagnaaggccttcnnnnnnnccgttcgatcgccaaggacgtcaccgagttgatcgggaacacgccgctggtgtacctcaacaaggtgaccgatgggtgcgtcggccgcgtcgccgccaagctcgagtccatggagnccctgctccangcgtcaagggataggattgggctacagcatgatcacggacgcagaggagagagggctgattactccaggcgtgagtgttctgattgaacaactagcggcacacaggcatgggactggcctttatggctgctgccaggactacaaactacactcacatgcctgcctccatgagcatggagaggaggatcatattgaaggcttttgggggctgaacttggcccttaccggacccaattctttgggaaatgaaaagggaccttgtccagaaaaccggaagaaaaatcccaacc

SEQ ID NO: 39709 - DNA, 665 bp, Zea mays
  misc_feature: Ceres CLONE 1430284-F
  misc_feature: Encodes the peptide sequence at SEQ ID NO. 39710
gcgggaatttccacgagaccattacctagaacatcctaatcgaaaaaagactcaagggccaaggtagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacctacccgctaacttgctcgtgctttgatcgggttgagcgctgctccgacgcctgtaaggagtgcgtggaaacggaggactcgcgccacttctgcgtcgacaggtaccgtggtgattccgggccccaggtgccacgacgaagacgggaggagcggcggacccgctgacgacgacgctggtgggcaaccgacgccgaccggcagtgatggcagatgaccagaaagcaggccgcggcgaaccaccacaagaagaagaagccgttggaaatgctgcgaagtgccccatcctgccccaggtcccgggcctcc

SEQ ID NO: 39710 - protein, 130 aa, Zea mays
  misc_feature: Ceres CLONE 1430284-F
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHFCVDRYRGDSGPQVPRRRREERRTR

SEQ ID NO: 39711 - DNA, 674 bp, Zea mays
  misc_feature: Ceres CLONE 1430287-F
  misc_feature: Translation starting site: 566
  misc_feature: SWISSPROT Homolog: EC 2.7.6.1 Ribose-phosphate diphosphokinase
  misc_feature (533)..(533): n is a, c, t, g, unknown, or other
aaagctggagctccccgcggtggcggccgctctagaactagtggatcccccgggctgcaggaattcgcacgaagaccattacctagaacatcctaatcaaaaaaagcagagtctgcccctccccgcgccgttctttttggttccccactccccagtccccgccgccgccgaaacccgcagatggaggtcgtcgtcgccgcgaagcagaaggcgaagaacacatacacctcttctactgctcagaatgcgaggagctcgccctcaagatcgccgccagctccgacgccatcgagctccaatccatcaactggcggagcttcgacgacgggttcccgaacctgttcatcaacaaggcgcacgacatccgtgggcagcacgtggcgttcctggcctccttcagctcgccgtcggtcatattcgagcagatctccgtcatcttcgcgctgcccaagctattcattgcctcattcactctcgtgctgcctttcttcccacgggctcattcgagcgcgttgaagaagagggcgatgtcnccaccgcggtcaccctcgcgcgcattctctcgatgatccccaagtcgcgcggggggcctaccagcgtcgtcatctacgacatccacgcgctccaagaagagttctactttcgggacgacgtccctgccatgcttcgagaca

SEQ ID NO: 39712 - DNA, 705 bp, Zea mays
  misc_feature: Ceres CLONE 1430291-F
  misc_feature: Encodes the peptide sequence at SEQ ID NO. 39713
ccccgcggtggcggccgctctagatctagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttaggggtggtatgcagatctttgtgaaacccttactggcaagaccatcactcttgaggtggag

SEQ ID NO: 39713 - protein, 169 aa, Zea mays
  misc_feature: Ceres CLONE 1430291-F
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKPLLARPSLLRW

SEQ ID NO: 39714 - DNA, 665 bp, Zea mays
  misc_feature: Ceres CLONE 1430300-F
  misc_feature: Encodes the peptide sequence at SEQ ID NO. 39715
  misc_feature (372)..(372): n is a, c, t, g, unknown, or other
  misc_feature (585)..(585): n is a, c, t, g, unknown, or other
aagctggagctccccgcggtggcggccgctctagaactagtggatcccccgggctgcaggaattcgcacgagaccattacctagaacatcctaatcgaaaaagagcgctctaagccgtttttcctcgtcctcgatccagccccctgccgcttccagctccgatcgatctgatccctccccaccaccacgcccatggcggaccaactcaccgacgaccagatcgccgagttcaaggaggccttcagcctcttcgacaaggacggggatggttgcatcacgaccaaggagctgggaactgtcatgcgttcactggggcaaaaccctacagaggctgagctcccagacatgatcaatgaggtcgatgccgacggncacggcaccatcgattgttcagagttttctcaccttatggctcgcaagatgaaggacaccgactctgaggaagagctcaaggaggcctttcgtgtgtttgacaaggaccagaacggcttcatctctgccgccgagctcccgcatgtcatgacaaatctgggggagagctaactgatgaggaggtagacaagatgatccgtgaggctgatgtcnatggtgatggccaaattaaactacgagagtttgtcaaggtcatggatgccaagtgagccacaaaaccataggctcaaggg

SEQ ID NO: 39715 - protein, 116 aa, Zea mays
  misc_feature: Ceres CLONE 1430300-F
  misc_feature (12)..(40): Pfam Name: efhand Pfam Description: EF hand
  misc_feature (85)..(113): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELPDMINEVDADGHGTIDCSEFSHLMARKMKDTDSEEELKEAFRVFDKDQNGFISAAELPHVMTNLGES

SEQ ID NO: 39716 - DNA, 693 bp, Zea mays
  misc_feature: Ceres CLONE 1430303-F
  misc_feature: Encodes the peptide sequence at SEQ ID NO. 39717
  misc_feature (1)..(1): n is a, c, t, g, unknown, or other
  misc_feature (26)..(26): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
ntttttttttttttttttttttttcnatancaannnaannnnaannggccgccnnnnnnttcagagctggactccccgcggtggcggccgctctagaactagtggatcccccgggctgcaggaattcgcacgagaccattacctagaacatcctaatcgaaaactccttactctacctgaccagctcggcagctccccagccgcgacagagtccacgacgacgatctttcttcccagttccccccgtctgcctccggatccgagctcccctgcccgctcggtcgactccctcgtcgccgagtccagctccgactccgagaaaaaaatcaaatcgaccgagtccgcccgtgaagccgccgacagaaggagagagcacacagcgggcgaggcaggcagcatgaagtccatgggcagccgcgacaagctcgcggcggcgtcgagccaccgccgcgtcctcttggtggtcttcgccttctgcttcgccttcgccaccttcctcaccttcctctacaccacctcccacttcacgaccgcgcccggctccggctccggctccggctccatcgcggcctctaccaccaccaccaccaccacgacctccggctctgcgggcggcggcggcccaggccaagcagggcccgagtccgtgtccaagcggctgccggtcccggtgttcgaggcgctggtccacta

SEQ ID NO: 39717 - protein, 98 aa, Zea mays
  misc_feature: Ceres CLONE 1430303-F
MKSMGSRDKLAAASSHRRVLLVVFAFCFAFATFLTFLYTTSHFTTAPGSGSGSGSIAASTTTTTTTTSGSAGGGGPGQAGPESVSKRLPVPVFEALVH

SEQ ID NO: 39718 - DNA, 722 bp, Zea mays
  misc_feature: Ceres CLONE 1430305-F
  misc_feature: Encodes the peptide sequence at SEQ ID NO. 39719
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (31)..(31): n is a, c, t, g, unknown, or other
ttgtgggttttcccnnnnngggccgggccgngggccggcggggagcgcagttcaaacaaactggaactccccgcggtggcggccgctctagaactagtggatcccccgggctgcaggaattcgcacgagaccattacctagaacatcctaatcgaaaagccaccagcccaccatcacccccacgaaaaaagcgaaccgagggagaggaaggatcggcgcgttccggccggagatgaggggcggatccagaccggccccggtcgtcctgtttctcctcgctgcgtccgggatctgcgcccagttcaccgcagtgctagctggtgatccccaaacatccaacgatgataagaaggctgaagctcagccaaagggccataccggcaaaacagttttgttcgtcctcctaggagtgggggctgtcattctgttgtcatttgttattttcaagtattggcagaagaagaaaaggcaggaacagcatgcacgtctgctaaagctatttgaagaggatgacgacattgaggttgagcttggtcttcgagattgataatcttcaattgtacagcaagagtatcttggctgacaaggatgctttgataataggctttaaggaggaagtatcaagggtttggagaaacaataatttgattttttgaaagttttcccgaatatattataatgtggcatcctaggaaaaggaaaacctcggtaaaacctattga

SEQ ID NO: 39719 - protein, 104 aa, Zea mays
  misc_feature: Ceres CLONE 1430305-F
MRGGSRPAPVVLFLLAASGICAQFTAVLAGDPQTSNDDKKAEAQPKGHTGKTVLFVLLGVGAVILLSFVIFKYWQKKKRQEQHARLLKLFEEDDDIEVELGLRD

SEQ ID NO: 39720 - DNA, 823 bp, Zea mays
  misc_feature: Ceres CLONE 1430308-F
  misc_feature: Encodes the peptide sequence at SEQ ID NO. 39721
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
ggggtgcccccgctcnntccncccacatctctccgtcaaaccaccccgcccatactggagctccccgcggtggcggccgctctagaatagtggatcccccgggctgcaggaattcgcacgagaccattacctagaacaccctaatcgaaaaagctgcgacgccgtcaacctgacggaggccggcaccaacgccaagccggtgggcaaggaggtcggccgcaagccggctgcctgccccgccgcctcaggcgacccccggattgcacggcatttccgacgccatcagcgtcatgcggggcttacccggggaaggcagcggactcagggacatccccgaactgactgggtaaagcctcggagagatcatagacgccgtcgtacttgatcgctcaagctgcactttgagatggaccaaccgccgcgcttatggggtgattgagggccaaggtcctataatgtcccaccccctgcaatccccccccccccccgggtgggcggccaaattgtcaaaagcctcctggcgaaagcccagggaagcccccccggtccgaggtagacccttcctcacaacgctcgcttcctcccaatgccaaccgcctgcatgggcactagaacaaagtgcacctccggggaccccacacaaatgttttgcgaacaaacctgggaggcgcacttcctgtccgcaaagcttgcgggtgccggcacctgcaaggagatgattaaataccacgaataaaaaacacctctcacctccaaaagcttgcctactaagcacaaaataggtggctggtaaatacaccaacggggtaaacaagccggtggg

SEQ ID NO: 39721 - protein, 44 aa, Zea mays
  misc_feature: Ceres CLONE 1430308-F
MGTRTKCTSGDPTQMFCEQTWEAHFLSAKLAGAGTCKEMIKYHE

SEQ ID NO: 39722 - DNA, 710 bp, Zea mays
  misc_feature: Ceres CLONE 1430311-F
  misc_feature: Encodes the peptide sequence at SEQ ID NO. 39723
aagctggagctccccgcggtggcggccgctctagaactagtggatcccccgggctgcaggaattcgcacgagaccattacctagaacatcctaatcgaaaaatatgcgtattaggctgttcacgcacgcgacggtggagccgttcatcatcgccaccaagaggcagatgagcgccatgcacccgatccacaagctgctggagccgcacttcaaggacaacatgcagatcaacacgctggccaggagcatcctgctgagcgcgggcggcatcctggagaggaccatgtacccggggaagtacgccatggagatgtcctcggccatctactccgagtggaggttcacggagcagtccctgcccaacgagctcgtcaagaggggcatggcgtccaagatgggcggcggcgccatcgccctgcacgtggaggactacccgtacgcggtggacggcatggacgtgtggcgcgccatcgagggctgggtcaggacctactgcgcccacttctaccactccgacgccgcggtggccgccgacgcggagctgcaggcgtggtgggacgacgtccgccgcgtcggccacggcgaccgccagcgcgacccggcgtgctggctggacctcgactccgtggccaacctcgccgagtcgctgtccacgctcatctggatcgcctccgcgctgcacgccgccgtcaacttcggccagtacggct

SEQ ID NO: 39723 - protein, 202 aa, Zea mays
  misc_feature: Ceres CLONE 1430311-F
  misc_feature (1)..(202): Pfam Name: Lipoxygenase Pfam Description: Lipoxygenase
  misc_feature: SWISSPROT Homolog: EC 1.13.11.12 Lipoxygenase
MRIRLFTHATVEPFIIATKRQMSAMHPIHKLLEPHFKDNMQINTLARSILLSAGGILERTMYPGKYAMEMSSAIYSEWRFTEQSLPNELVKRGMASKMGGGAIALHVEDYPYAVDGMDVWRAIEGWVRTYCAHFYHSDAAVAADAELQAWWDDVRRVGHGDRQRDPACWLDLDSVANLAESLSTLIWIASALHAAVNFGQYG

SEQ ID NO: 39724 - DNA, 653 bp, Zea mays
  misc_feature: Ceres CLONE 1430323-F
  misc_feature: Translation starting site: 199
  misc_feature (313)..(313): n is a, c, t, g, unknown, or other
ctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctngaccagcagcggcttatcttcgccggcaagcagcttgaggacggacgcacacttgctgactacaacatccagaaggagtcaaccctccacttggtgctgcgcccttaggggaggcatgcagatcttttgttcaagacccttgacttgggcaagaacaatcacccccttggggggggggaactccccccaaaaccccccttggaaacaagggtccaggggcaaaaaaatcccccggaaaaaggggggggggcttccccccctggagcaaaaaaaagtcttttatttttttccgggaaaaaaattttggggggagggaggagggaccccctttgttaatcaa

SEQ ID NO: 39725 - DNA, 773 bp, Zea mays
  misc_feature: Ceres CLONE 1430326-F
  misc_feature: Encodes the peptide sequence at SEQ ID NO. 39726
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
tggggtggtttttnngtctncgcgggggcggcccgcccgcggcggnnncnnnnnntcaaaagctggactccccgcggtggcggccgctctagaactagtggatcccccgggctgcaggaattcgcacgagaccgttacctagaacatcctaatcgaaaaaaaaaaagaactccttccacgcccagccatctctaaaccctacccacagccaccgccgccgccgccgctccctgacccctagtgtccggatttaacttcaaacatggcggacgtcgatgtcgagccggaggtcgccgccggtgctcccaagaagaggacgttccgcaagtacagctaccgcggcgtcgacctcgatgcgctgcttgacatgtccaccgacgacctcgttcagctcttcccagcgcgcgccaggagaaggttccagaggggtttgaagaggaagcccatgggcgctcatcaaggaagctgcgcaagggccaaaaagggatgctccctgtcggggaagaagccagagccagggaaagacccctcctccgcaaaatggatcatttgtcccccgagatgaattgggaagcattggttgggtggcctacaagggggcaggacccttccacccagggttgaagaatcaagccccggagaaggaggtgggcccactaatcctgggcagagatgcaccccatttccccagcaggggcgggtccaaacaaccgggaagggccccgggtttgtggggggcccacctcaacccccctctacggggtttagtcccc

SEQ ID NO: 39726 - protein, 100 aa, Zea mays
  misc_feature: Ceres CLONE 1430326-F
MADVDVEPEVAAGAPKKRTFRKYSYRGVDLDALLDMSTDDLVQLFPARARRRFQRGLKRKPMGAHQGSCARAKKGCSLSGKKPEPGKDPSSAKWIICPPR

SEQ ID NO: 39727 - DNA, 726 bp, Zea mays
  misc_feature: Ceres CLONE 1430327-F
  misc_feature: Encodes the peptide sequence at SEQ ID NO. 39728
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaacgaaaaagaaaaaattcagcaaacaagcaaaggtacggccaccaccaccggccaggaagcaagctcaaaccctaaccgccggcgacgccagcacgatggcccgctacgaccgcgcgatcaccgtcttctcccccgacggccacctcttccaggtcgagtacgccctggaggccgtccgcaagggcaacgccgccgtcggcgtccgcggcacggacaccgtcgtcctcggtgtggagaagaagtcaacccccaagctccaggactccaggtccgtgcgcaagatcgcgtgcctggacacccacatcgctctggcatgcgcggggctgaaggcggacgcacgcgtgctcatcaaccgcgcgcgggtcgagtgccagagccaccgactcaccgtcgaggaccccgtcaccgtcgagtacatcacccgctacatcgctgggctgcagcagaagtatacacagagtggtggagtccgccccttcggcctctccacactcattgtcggcttcgacccctacaccgacaagccagcgctgtaccagaccgatccttctggtaccttctctgnctggaggcgaacgccacgggaaggaactcaactctatgcgtgagtttctggaggagacta

SEQ ID NO: 39728 - protein, 170 aa, Zea mays
  misc_feature: Ceres CLONE 1430327-F
  misc_feature (27)..(171): Pfam Name: Proteasome Pfam Description: Proteasome A-type and B-type
  misc_feature: SWISSPROT Homolog: EC 3.4.25.1 Proteasome endopeptidase complex
  misc_feature (157)..(157): Xaa is any aa, unknown, or other
MARYDRAITVFSPDGHLFQVEYALEAVRKGNAAVGVRGTDTVVLGVEKKSTPKLQDSRSVRKIACLDTHIALACAGLKADARVLINRARVECQSHRLTVEDPVTVEYITRYIAGLQQKYTQSGGVRPFGLSTLIVGFDPYTDKPALYQTDPSGTFSXWRRTPREGTQLYA

SEQ ID NO: 39729 - DNA, 668 bp, Zea mays
  misc_feature: Ceres CLONE 1430336-F
  misc_feature: Translation starting site: 111
  misc_feature: SWISSPROT Homolog: EC 3.6.3.14 H(+)-transporting two-sector ATPase
  misc_feature (209)..(209): n is a, c, t, g, unknown, or other
  misc_feature (306)..(306): n is a, c, t, g, unknown, or other
  misc_feature (350)..(350): n is a, c, t, g, unknown, or other
ggagctccccgcggtggcggccgctctagaactagtggatcccccgggctgcaggaattcgcacgagaccattacctagaacatcctaatcgaaaaatcggagagcaattatggcttcaggtttcagcggcgatgaaactgctcctttcttcggattcctcggcgctgccgccgctctcgttttctcatgtatgggagcagcgtacggnacagcgaagagcggggtcggcgtggcgtccatgggtgtgatgagaccagagcttgtgatgaaatcgattgttcccgtggtcatggctggtgtgttangtatctatggtctcatcattgctgtcatcatcagtactggaatnccaccctagggccagtcttactacctgtgggacggttatgctcatctctcttccggtctcgcttgtggtctcgccggtctctccgcccgtatgctattgtatcctcggcgacgctggtgttagagcgaatgcacaccacccgaagctgtttgggggaatgattttaattctcatctttgcggaagcacttgcgctgtacgggctcattggtgggatcatccctctcgcctcgggctggccagtcctagagcccaggtgacctcagaaacccctttgggcaagtcctttttgaatgggttataatatgtttcacttttg

SEQ ID NO: 39730 - DNA, 669 bp, Zea mays
  misc_feature: Ceres CLONE 1430338-F
aaagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctcgatgc

SEQ ID NO: 39731 - DNA, 720 bp, Zea mays
  misc_feature: Ceres CLONE 1430355-F
  misc_feature: Encodes the peptide sequence at SEQ ID NO. 39732
aagctggagctccccgcggtggcggccgctctagaactagtggatcccccgggctgcaggaattcgcacgagaccattacctagaacatcctaatcgaaaaaacgctgtccgccgccacctctcctccggcatcgacgaggcgaaaccctagcgcccgagtccctctccctgctcccacaacccatggcggcggatatggcgtacgcgccgccgatgaaggctggcaaggccgggttcgaggctggcatgatggatccacagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccaggaagtctccctgtggagaaggtaccaacacctgggatcgctttgagatgaggattcacaagagggtgatcgatctcgtcagtacaccagacgttgtcaagcagatcacctcaatcaccattgaaccaggtgtcgaggttgaggtgactatcagtgacgcttaatatggtagccttatcatttcaaaaggcttctagtgaacaggatatttttcattcctagtgagaacttgtgtaacagaggaatccaagtatttcatatcagagtttaaaagtctaatcgagggtcgccgtattgatgtatcctgtttcaa

SEQ ID NO: 39732 - protein, 128 aa, Zea mays; identical to SEQ ID NO: 36192
  misc_feature: Ceres CLONE 1430355-F
  misc_feature (28)..(123): Pfam Name: Ribosomal_S10 Pfam Description: Ribosomal protein S10p/S20e

SEQ ID NO: 39733 - DNA, 757 bp, Zea mays
  misc_feature: Ceres CLONE 1430356-F
  misc_feature: Encodes the peptide sequence at SEQ ID NO. 39734
aagctggagctccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctctttcgagagaccctgtaccagaagaccaaggatgggcagccttttttgtgatgtcctcaagggagggaggcgtcctcccctggcatcaaggttgacaagggcaccattggaggtgtttggccctgataggagaaccacacccaaggccatgacaaccttggcaagcctttgccaagtactacaaggcagggcccccctttgcaaaggggccccttttcccaaaatgggcccaaaggaaccttcaagttggcctccaactgaaaccccaggggctgggccccatttccatactctcccaagaaaagggctcgggcccattgtagacccgaaaccctttggaaggccccccaaaaattaacccc

SEQ ID NO: 39734 - protein, 90 aa, Zea mays
  misc_feature: Ceres CLONE 1430356-F
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFRETLYQKTKDGQPFL

SEQ ID NO: 39735 - DNA, 666 bp, Zea mays
  misc_feature: Ceres CLONE 1430363-F
  misc_feature: Encodes the peptide sequence at SEQ ID NO. 39736
  misc_feature (352)..(352): n is a, c, t, g, unknown, or other
ctggagctccccgcggtggcggccgctctagaactagtggatcccccgggctgcaggaattcgcacgagaccattacctagaacatcctaatcaaaaaaaccacatccagtccaccccatccccctcgaccccgacaaccccgagtcccgacccgatggcgcccaaggccgagaagaagccagcggagaagaagccggcggccgaggagaaggcggagaagacgaccgcaggcaagaagcccaagtccgagaagcgcctgcccgccctcgagtcctccggcaaggagggcggcgagaagaaggggaagagaagggccagaagagcgtggagacctacaaaatctacatcttncaggtcctaaagcaggtgcaccccgacatcggcgtctcctccaaggccatgtccatcatgaactccttcatcaacgacatcttcaagaagctcgccggcgaggccgctaagctcgcccggtacaacaagaagcccaccatcacctcccgggagatcaagacctcggtgcgcctcgtcctcccaggagagctcgccaaacacgccgtctcggagggaacaaggccgtcaccaagttcaccagcattggagcaccctgcagcctcacggatttgttaggcctccccttcttacaagggttcttcggcgtggccccc

SEQ ID NO: 39736 - protein, 75 aa, Zea mays
  misc_feature: Ceres CLONE 1430363-F
MSIMNSFINDIFKKLAGEAAKLARYNKKPTITSREIKTSVRLVLPGELAKHAVSEGTRPSPSSPALEHPAASRIC

SEQ ID NO: 39737 - DNA, 678 bp, Zea mays
  misc_feature: Ceres CLONE 1430365-F
  misc_feature: Encodes the peptide sequence at SEQ ID NO. 39738
  misc_feature (324)..(324): n is a, c, t, g, unknown, or other
aagctggagctccccgcggtggcggccgctctagaactagtggatcccccgggctgcaggaattcgcacgagaccattacctagaacatcctaatcgaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccggcccttcgtgggatcttgaaaattngatgttctaatggagtcccaagggtgcaagaagaagtctagcagtagtcgttcctccgtgatgtacgaagctccccttggctacagcatcgaggatatccgccctgcaggcggcatcaagaagttctccgctgcttactcgaactgcgcgaggaagccatcctgatatctctgtcctcatccccatcctagtagcggtagaaccacctgcattttcattttgatcccccctaatcctccggctagctgcttttcagtgaccaaaagaatcaaaaaccacttcccgtcttccctcccgggggtgtctggcatctggctctaaaacaatgccgtccctccaagttgcttcctcctc

SEQ ID NO: 39738 - protein, 51 aa, Zea mays
  misc_feature: Ceres CLONE 1430365-F
  misc_feature (1)..(51): Pfam Name: AdoMetDC_leader Pfam Description: S-adenosyl-l-methionine decarboxylase leader peptide
MESQGCKKKSSSSRSSVMYEAPLGYSIEDIRPAGGIKKFSAAYSNCARKPS

SEQ ID NO: 39739 - DNA, 631 bp, Zea mays
  misc_feature: Ceres CLONE 1430366-F
  misc_feature: Translation starting site: 206
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtggttcatgatcttcagccccgtgctcgccccgccgcgctgctcatgggacggccgtcatggggttcctcacgtcgggcgcgctggggctcggggggcctgtcctcgctcacgtggcctcgcccaaacggggcgggaagggggtccaacccaccccggaataactgggaagaagcccaccgc

SEQ ID NO: 39740 - DNA, 633 bp, Zea mays
  misc_feature: Ceres CLONE 1430368-F
  misc_feature: Translation starting site: 129
  misc_feature: Pfam Name: Ham1p_like Pfam Description: Ham1 family
  misc_feature (176)..(176): n is a, c, t, g, unknown, or other
  misc_feature (216)..(216): n is a, c, t, g, unknown, or other
aagctggagctccccgcggtggcggccgctctagaactagtggatcccccgggctgcaggaattcgcacgagaccattacctagaacatcctaatcgaaaattacttttagctatctgagaatagaaaatggcggcggcggcggcgaaagcagcggtggtattgccacgtccggtngacgtttgtgacgggaaatgcgaagaagctcgaagagtcnagctatcatcggagttcattcctttcagtctctcaactcgacctgctgagcttcaggagagctgaggatatctcaaagagaagctcgtttggctgctcttcagtaaatgaccagtgctgggggagatacatgcctctgtttcaatgcttgaaaggtcttcctgggccttacatcaggtgggttccttggaaaactttggcccttgaaggtttttaaaacacttttccttgtggcctcttgaaaaaaaaaacccccttttggcttgggggggcttccctttttccccccgggggcccggggttgaaacccctttttttttttgggggaaactctcgggggaaaaaattttcccccccaaaagccccccctttttttcgggggggggacccccggtttctcccccggagggaaaaaacc

SEQ ID NO: 39741 - DNA, 717 bp, Zea mays
  misc_feature: Ceres CLONE 1430378-F
  misc_feature: Encodes the peptide sequence at SEQ ID NO. 39742
tggagctccccgcggtggcggccgctctagaactagtggatcccccgggctgcaggaattcgcacgagaccattacctagaacatcctaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgcccgtccacctgccgccgccggtccacctgccaccgccggtccatgtgccgccccccggttattctgcccgcccccccatggcccttccccttattaaacgccccgggctttagccttttccccaggccacacccctgggccgggggcaaaaagcccattttcataccccggttcccctttgggggaaaccccccgcgtgtggccccaccccccccccctgggggcatggtgtctaaatgtccccaggaaaaaaaggtgtgccccccacaggggagaccccccctatttccccccacataaagaaaaagttttgcggacaaagatgttttccccacccacccccgcgggggggggcccccaccccacccttcaataggatttttt

SEQ ID NO: 39742 - protein, 93 aa, Zea mays
  misc_feature: Ceres CLONE 1430378-F
MRVLLVALALLALAASATSTHTSGGCGCQPPPPVHLPPPVHLPPPVHLPPPVHLPPPVHLPPPVHLPPPVHVPPPGYSARPPMALPLIKRPGL

SEQ ID NO: 39743 - DNA, 684 bp, Zea mays
  misc_feature: Ceres CLONE 1430379-F
  misc_feature: Encodes the peptide sequence at SEQ ID NO. 39744
  misc_feature (333)..(333): n is a, c, t, g, unknown, or other
  misc_feature (341)..(341): n is a, c, t, g, unknown, or other
aaagctggagctccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcngcggctgncgcgggtcgggaccgactatgggacggaccgacagcaagatctccccccgacgagaccttcttcaagggctgcaactacaccactggggtcatcaccatggaacttcccggaccccaagccttccccccaaaaaaattaatcaaaaaatccttccaaaactccccccagggccctcgggggatttttaaggaaggccaaaaaaaaaaaattttgcttttttaaaccaacaacttttttttgggtttttccgggccttttatcccccagaaaaatttccaaaaaaaattctccgggttttcccccggagaaaatttttttttttttgccccaaaaaaaaaaaag

SEQ ID NO: 39744 - protein, 139 aa, Zea mays
  misc_feature: Ceres CLONE 1430379-F
  misc_feature (66)..(66): Xaa is any aa, unknown, or other
MALALRLRRVLAAASTAAPLLRPSTSVARPCPLVPLASPVAPLPLPPWRFLPGGGAGFRSTAAAAXAGRDRLWDGPTARSPPDETFFKGCNYTTGVITMELPGPQAFPPKKLIKKSFQNSPQGPRGIFKEGQKKKILLF

SEQ ID NO: 39745 - DNA, 649 bp, Zea mays
  misc_feature: Ceres CLONE 1430384-F
  misc_feature: Encodes the peptide sequence at SEQ ID NO. 39746
  misc_feature (511)..(511): n is a, c, t, g, unknown, or other
ggagctccccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagacgaagagcctgctgttggcgctcagcgtggcggcgctgctcgcggcgcagtcggactcccacggcctgggggacttcacgagcgggagcggcgaggcgacgacgacgccggagatgcagaccttcttcaagccccaggccgctgcggcgctcccggaggccctcgacgcctccatgcccgccaagccggaggcggcggcggcggcgctcccggccacgacaagggccggcacggcgccgtcagccacgccgcgcaggcccgtgtccgtggccgccgggcgtgcccctgcggcntgggcgccgtggccgtgggcggcatcccttgcgccctggcttaacttgtgccccggcccccgccccgggacggaagtgcacttccgcttcctccccgggagcccccgtccgggccggggcccggtggaataggcgtcc

SEQ ID NO: 39746 - protein, 145 aa, Zea mays
  misc_feature: Ceres CLONE 1430384-F
MACKTKSLLLALSVAALLAAQSDSHGLGDFTSGSGEATTTPEMQTFFKPQAAAALPEALDASMPAKPEAAAAALPATTRAGTAPSATPRRPVSVAAGRAPAAWAPWPWAASLAPWLNLCPGPRPGTEVHFRFLPGSPRPGRGPVE

SEQ ID NO: 39747 - DNA, 656 bp, Zea mays
  misc_feature: Ceres CLONE 1430386-F
  misc_feature: Encodes the peptide sequence at SEQ ID NO. 39748
  misc_feature (526)..(526): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcngtggcagcaccccgatcctgggccagttgcgtcgagtttcctgagggattagtgaaacccaaagggaaccccctactggtcccctcaatgccatcctttgcggcaacatggttcccagaacctcaggcag

SEQ ID NO: 39748 - protein, 132 aa, Zea mays
  misc_feature: Ceres CLONE 1430386-F
  misc_feature (119)..(119): Xaa is any aa, unknown, or other
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGTCGXGSTPILGQLRRVS

SEQ ID NO: 39749 - DNA, 659 bp, Zea mays
  misc_feature: Ceres CLONE 1430390-F
  misc_feature: Pfam Name: Pantoate_transf Pfam Description: Ketopantoate hydroxymethyltransferase
  misc_feature: SWISSPROT Homolog: EC 2.1.2.11 3-methyl-2-oxobutanoate hydroxymethyltransferase
  misc_feature (289)..(289): n is a, c, t, g, unknown, or other
aagctggagctccccgcggtggcggccgctctagaactagtggatcccccgggctgcaggaattcgcacgagaccattacctagaacatcctaatcgaaaaatcccacaccaaccctctgtgcctcggtccctccgcccgtacgcgcgacgagagacacgatgcggcggtccctaccccttctcctcgcgcggcaggtggcgcggcggcggcggctgaacaacgtgccggagtccaccgtctacgggggcccacgcccgcaggagtccctcgcggcgcggcgcgtgacngtgacccacactccgtgggaagcacccgcgcggggagcccatcaacgtcgtcaccggctacgactacccctcggcggtccacgtcgactcccgcggcatcgacgtctgcctcgtcggggactccggcgccatggtcgtccacggccacaaaccacgcttcccatcacgctcgaaatcatgctccagcactgcccccgcctggcccggggggcgcccccgccccctcctcggtggggatctcccattcgggtggtacgattccctcggccgcccaagctggttattccacccctgagggtcctcaaagaaggggggaatggatccaatccaactgggaagggggtgcccccatcgaaggatcactgccgcc

SEQ ID NO: 39750 - DNA, 667 bp, Zea mays
  misc_feature: Ceres CLONE 1430398-F
  misc_feature (216)..(216): n is a, c, t, g, unknown, or other
  misc_feature (217)..(217): n is a, c, t, g, unknown, or other
  misc_feature (223)..(223): n is a, c, t, g, unknown, or other
  misc_feature (224)..(224): n is a, c, t, g, unknown, or other
  misc_feature (228)..(228): n is a, c, t, g, unknown, or other
  misc_feature (229)..(229): n is a, c, t, g, unknown, or other
  misc_feature (344)..(344): n is a, c, t, g, unknown, or other
  misc_feature (352)..(352): n is a, c, t, g, unknown, or other
  misc_feature (353)..(353): n is a, c, t, g, unknown, or other
  misc_feature (363)..(363): n is a, c, t, g, unknown, or other
  misc_feature (364)..(364): n is a, c, t, g, unknown, or other
  misc_feature (388)..(388): n is a, c, t, g, unknown, or other
  misc_feature (389)..(389): n is a, c, t, g, unknown, or other
  misc_feature (396)..(396): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
aaagctggagctccccgcggtggcggccgctctagaactagtggatcccccgggctgcaggaattcgcacgagaccattacctagaacatcctaatcgaaaagaacaagagcaaagccctgaaatccttctccccctgcacgcacctgcagacctgctctctcgcgcgcatctcccgtgcccctcactgtttagtggcgacgactgggcgacagtnncgccgnnccgnnccgcccgctaggggccgtgcccctggtctccatcttcgggcgcttcgcccaccagatatgagcagctggcaattcgattttgaggccattatttgataacccgggacaagtgcanctgttacnnctgaccattnnttagcttgggttcagaatggcctnnacacagntttgccatgcttcacacagctcagtccaccgtcttgtagttggaataaaagatgtcnngnaactgcaaaggctacgcctgatagggtagccagaagtgccccgagcttgggccactgtcacttccgtgctgtgcaggccccccgtatgcaacctctttcaagaagaaagaccttttcgagaaaaaagatcttttcctcgactttcatcggagggtatctttgtccctggccaaaaaaaatgcccaaggtttgccccaatgaaaggttcccc

SEQ ID NO: 39751 - DNA, 711 bp, Zea mays
  misc_feature: Ceres CLONE 1430403-F
aagctggagctccccgcggtggcggccgctctagaactagtggatcccccgggctgcaggaattcgcacgagaccattacctagaacatcctaatcgaaaaactccgctgggttcatttgcggctcctgtccgctgatctgatctcctgtgacgttgaaggatctgggatgggctaaccgcgacggctacgtgtggggccttgcggccgtgtttctgcgacacgctcgccgccatctccgccaagttcatctccgctttgtggtttggatgtgcctccctcctccttctgggcgtcttcatcctctctccgtccggcgtcgcggatcctcagaccgcggatcaggtggactcctgttgaccgctagtgctcgctgtctcttgtccgtactcttgataccctgatccttgaggatgttttgtccgtcctgtctgccgatcagaccatgactgtcgatcgtcttatacaatggaccgagcagacgtgtatgtgagagtcttctcaccaggacatttgacttttcccatggtgctgctgcgacatcgagaatcatctctgtagttgaacgtggggggggaagtgatcactgctcacgatgtagaccccattcagcttgtcggctagttacctgctctttgcttatcgatggcgtcgctctctgggttgtgcccggcacctctactctctaacggtagtccacctacgcacgctg

SEQ ID NO: 39752 - DNA, 665 bp, Zea mays
  misc_feature: Ceres CLONE 1430409-F
  misc_feature: Encodes the peptide sequence at SEQ ID NO. 39753
aaagctggagctccccgcggtggcggccgctctagaactagtggatcccccgggctgcaggaattcgcacgagaccattacctagaacatcctaatcgaaaagcgattttaccgtggacgactggagagggcgacggggacgaacgagacgaccgtacattcgttatcggactgggaagcagcggcggtacaaagtgtgggagagaaaggagaagagacttgatgtcctcgcagtttgtccaatagatctcctcgccgcctcacccgtctcctcctccgcagcttccccgcgatcccgaccatggagggcgacggtaccaaccttgatgcggcgatagagtcgctcctgaatgtcgagaagcagatgaggctggccggagatgtcgccggcactcggaaggccgtcatcgacatcgtcgagctctgctacaaggccggcgcgtggaagacgctaaacgaccagatcgttctcctatctaagaggagaggccagcttaagcaggctattactgctatggttcagaaagcaatggagtatattaatttgacaccaggcattgacacaagcatcgagctaataaaaacactgagcagtgtctctgctggcaaaatctatgttgagatagagagagcaagattgatcaaaaagcttgcaaaaattaagg

SEQ ID NO: 39753 - protein, 121 aa, Zea mays
  misc_feature: Ceres CLONE 1430409-F
MEGDGTNLDAAIESLLNVEKQMRLAGDVAGTRKAVIDIVELCYKAGAWKTLNDQIVLLSKRRGQLKQAITAMVQKAMEYINLTPGIDTSIELIKTLSSVSAGKIYVEIERARLIKKLAKIK

SEQ ID NO: 39754 - DNA, 741 bp, Zea mays
  misc_feature: Ceres CLONE 1430410-F
  misc_feature: Encodes the peptide sequence at SEQ ID NO. 39755
aagctggagctccccgcggtggcggccgctctagaatagtggatcccccgggctgcaggaattcttacgagaccattacctagaacatcctaatcgaaaatccatccccgcgacgacccaccacccacccctgcagtctgcagcatccccttccccactcccggctggtctgctgcggccacccctgcgccgatccacctccgctgcttcctgcctcaatatattcgcccgcctcgtcgcctccgaccccgccacagaaggccttccagaaccctccgacccctcacctccgctccgccccgctccactctcctcctcccgggccggccgactccgatggccgtcgtcgaggccgccgcagccgaccacgccgcgccgccgctccaggaggaggcaccgggcgcgggcgctggcgctggcgccgacgccggggagcgcgagatgcgggatctggaggacctgctctccaagctcaaccccatggccgaggagttcgtcccgccctccctcgcctcccccgccgccctcacgcccgcgccgctctcccccgcccgctacggcttctacccggccgggcgcggcttcgcggtcgcctcgccgggcacggcggcgtcgtcggcttcccggccgtcgcggacgcccacgccccacgagcaggaagaaaggcggagcttggaggagggttcagccggccacggtcaccccgcagggaaggggacccacagccgccaccagcatggg

SEQ ID NO: 39755 - protein, 135 aa, Zea mays
  misc_feature: Ceres CLONE 1430410-F
  misc_feature (41)..(58): Pfam Name: PAM2 Pfam Description: Ataxin-2 C-terminal region
MAVVEAAAADHAAPPLQEEAPGAGAGAGADAGEREMRDLEDLLSKLNPMAEEFVPPSLASPAALTPAPLSPARYGFYPAGRGFAVASPGTAASSASRPSRTPTPHEQEERRSLEEGSAGHGHPAGKGTHSRHQHG

SEQ ID NO: 39756 - DNA, 684 bp, Zea mays
  misc_feature: Ceres CLONE 1430412-F
  misc_feature: Translation starting site: 283
  misc_feature (200)..(200): n is a, c, t, g, unknown, or other
  misc_feature (217)..(217): n is a, c, t, g, unknown, or other
  misc_feature (226)..(226): n is a, c, t, g, unknown, or other
  misc_feature (328)..(328): n is a, c, t, g, unknown, or other
  misc_feature (352)..(352): n is a, c, t, g, unknown, or other
  misc_feature (436)..(436): n is a, c, t, g, unknown, or other
  misc_feature (591)..(591): n is a, c, t, g, unknown, or other
  misc_feature (661)..(661): n is a, c, t, g, unknown, or other
gctccccgcggtggcggccgctctagaatagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagcccacgagacggcagcaatggcngaccgtgaacggcagcngcatctacngcggcgcccacgccacctacgggcagcagcagcagcagggaggaggcgggcccccaatgggtgagcaggtaaagggcatgctccacgaacaggggccgaacngcgtcccaggcgctgacggtggcnaacctgtttcccctgggcgggctggtggtgggtctttcggggcttggccttaccgcctccgtgggggggctggccctgcccacncccgttttcctgattcttcaccccttgctggtccccgccccgctgcttaatgggaacgcccgtatggggttcctccactcggggccccctgggcgtccggggccctttcctcccttaagttggcttcgcaaaaaggggggggagggggttcccancccccccccggaaattagtggaaggaagccccccccccaaggatggggaaagggccccccccccaacccnggccaaaaaaaaacccgggaagg

SEQ ID NO: 39757 - DNA, 768 bp, Zea mays
  misc_feature: Ceres CLONE 1430414-F
  misc_feature: Encodes the peptide sequence at SEQ ID NO. 39758
  misc_feature (459)..(459): n is a, c, t, g, unknown, or other
  misc_feature (702)..(702): n is a, c, t, g, unknown, or other
ggagctccccgcggtggcggccgctctagaactagtggatcccccgggctgcaggaattcgcacgagaccattacctagaacatcctaatcgagaagcaaactcgaccagatgtttgaataattctactttacaacatgtgaaccttaattttaagttaagcccccttctctctcacctcgatgcggcttgccaaccgccgatctgcccggccaaggattgttgagctcgccgcgggctaggtttccttccgtccaccatgacggggccaggctcagctccgacccaaacaccccctccagaacccaagcataacgcccgccgccccgtcctcctcctggggccgccactcctagccgtcgccgttgccctcctcttgggcgtatccaacaacccgttgccccgcctgcttcatccgccttcacgttagtaacaaggcgctgcggttgtccactccacngcaaggccagactcgcccgccggagggatgcttagagcggagtactcgaataccataccctaggagcttaacgacaccttggtcttctcccgggagctttgccaagggaaggcggcgaggtccttctccccggctccggcggtcggaaacctccggggcgaaggaagatgtaccatggtggcctcgaaacccggtaggcgaactccaaattgggatccaggtggcaagcccttgtgttccccngggtacccaacaagtccgagccgcggttattcgacccggagttccttccccccatgttaccatgtc

SEQ ID NO: 39758 - protein, 56 aa, Zea mays
  misc_feature: Ceres CLONE 1430414-F
MTGPGSAPTQTPPPEPKHNARRPVLLLGPPLLAVAVALLLGVSNNPLPRLLHPPSR

SEQ ID NO: 39759 - DNA, 611 bp, Zea mays
  misc_feature: Ceres CLONE 1430416-F
  misc_feature (198)..(198): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (415)..(415): n is a, c, t, g, unknown, or other
aaactggagctccccgcggtggcggccgctctagaactagtggatcccccgggctgcaggaattcgcacgagaccattacctagaacatcctaatcgaaaacccactctccctttccactctcaggctcccactccccccctaccggctaccctacccatcacacacaaacagccactcctcacctcccccgtcctcnggttcatgtcctgctgctcccatgtcgccccactcgacctcgactacataggcctctcgccggcggcggctgccgccgctgcccacgaccacctgaagggtaccgagctccgccctgggtcnnnnnnnnncccgggatccgatcccccnnnnnaaacccccgtgttgtgggtggcaccgaacccccccttgacctgggccgggtaagaggcccaaancccgggtttttccaaaaagggggccaaaccctttcccccggggatatttcccggaaaggaaaaaaaatgtcccaaaaaaagagaaaacaaaaaaaggtttttaaaaacccccccaccccggtgaaaaaaaaatttagggggggggggagggcccccccaattccaaaaattcccccccaaaaaaaaaaattttttt

SEQ ID NO: 39760 - DNA, 669 bp, Zea mays
  misc_feature: Ceres CLONE 1430418-F
  misc_feature: Encodes the peptide sequence at SEQ ID NO. 39761
  misc_feature (257)..(257): n is a, c, t, g, unknown, or other
  misc_feature (305)..(305): n is a, c, t, g, unknown, or other
  misc_feature (356)..(356): n is a, c, t, g, unknown, or other
  misc_feature (399)..(399): n is a, c, t, g, unknown, or other
  misc_feature (412)..(412): n is a, c, t, g, unknown, or other
aagctggagctccccgcggtggcggccgctctagaactagtggatcccccgggctgcaggaattcgcacgagaccattacctagaacatcctaatcgaaaacttccgaaatctcgtgcggcggccggcaagttcgcacttcgcagcgcattcaccaccagcttcactcccaactaccgctgatctcactcacgctcaccccagccggggcagcccgtcccatccggctagaggtcacatcacctgcgtgacgataancatcctcttcaaatcgtagtctagcccgtgcccaaaacctagcgaccngcggagagctcgtccgaatcgaggccaccgagggggaaatagatcgcggcngacgatggagagccctgcgaaagaggaggccgggggagagctngcaaatgaaatcnagtcgtcggtcacggcggaggactggccgcccgcccctttctcgcgtcgtgccgtccgtcgtcctcctccgcaccactgcgccgcgcgcctttgacaccgaagtcgcgggcgccagctaccccacgggtttcttcctttacaagtcccgccggatattcctcactaacccccatgtcttcaaagccaggacctggtggccccggaggcccatgtcctaaaaagggaaaaaatcccctgggtaccccctgtaaaaaaa

SEQ ID NO: 39761 - protein, 75 aa, Zea mays
  misc_feature: Ceres CLONE 1430418-F
MKSSRRSRRRTGRPPLSRVVPSVVLLRTTAPRAFDTEVAGASYPTGFFLYKSRRIFLTNPHVFKARTWWPRRPMS

SEQ ID NO: 39762 - DNA, 699 bp, Zea mays
  misc_feature: Ceres CLONE 1430421-F
  misc_feature: Encodes the peptide sequence at SEQ ID NO. 39763
ggcggccgctctagtctagtggatcccccgggctgcaggaatttcacgagaccattacctagaacatcctaatcgaaaacataattttttattaaaatctcttttgctctctcctttactttgctccgccacaatgcaaggaggcaccgtctcggttcactatcactcttatcgtctcctccagcacctccatgtgctgctcacggcacagaaatctggcaagggaaagaagccaggcaagggtggcaatcgattttggaagagcattggccttggtttcaagactcccagggaagcaattgaagggacctacattgacaagaaatgtccattcactggaaccgtttctatcagaggcagaattattgctggaacatgccacagtgctaagatgaacagaaccatcattgttcgcaggaactatctccactttgttaagaaataccagaggtatgaaaagaggcactccaacattccagctcacatctccccatgcttccgtgtgaaggaaggcgaccatgtcatcattggccagtgcaggcccctatcaaaaactgtgaggttcaatgtcgttaaagtcattccagctggatctgctgctgctggcaagaaggctttcaccgcagcctgagtttaaaactatgtttcatgagtagtttaatagagggatgtcttttttttgtcaaaaaaactgccttg

SEQ ID NO: 39763 - protein, 165 aa, Zea mays
  misc_feature: Ceres CLONE 1430421-F
  misc_feature (80)..(149): Pfam Name: Ribosomal_S17 Pfam Description: Ribosomal protein S17
MQGGTVSVHYHSYRLLQHLHVLLTAQKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSAAAGKKAFTAA

SEQ ID NO: 39764 - DNA, 747 bp, Zea mays
  misc_feature: Ceres CLONE 1430427-F
  misc_feature: Encodes the peptide sequence at SEQ ID NO. 39765
  misc_feature (621)..(621): n is a, c, t, g, unknown, or other
aagctggagctccccgcggtggcggccgctctagaactagtggatcccccgggctgcaggaattcgcacgagaccattacctagaacatcctaatcgaaaaattttccttcctcctcccacctcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagggcatcttcgcccgcgccaagcagtacgccgaggagtaccacgcccaggagaaggagcttgtgcagctcacgcgtgaggccgggggggaagggtgggttctatgtgagcccagaggcggagccttctgtttgggggtcgcgtcccgtggtatcaatgccgtgcgccccaggacccgggagatcttgcagctcctgcgattgagggagacgttcaggggtgttcccggggagggggaccgagggggccgtagaccagcggggcgcaggggcggagccgtagggtggcggaagggagtgcgcccagccgagaggagggntagggggggggtagctggcagagagaggtgggcgggggagggctgggccaggcagagggattcccgctgtgggaatcaccgtgtggccgtggggggggggggctgcgggggaggcgcgagtcggcg

SEQ ID NO: 39765 - protein, 192 aa, Zea mays
  misc_feature: Ceres CLONE 1430427-F
  misc_feature (14)..(82): Pfam Name: Ribosomal_L30_N Pfam Description: Ribosomal L30 N-terminal domain
  misc_feature (151)..(151): Xaa is any aa, unknown, or other
MSAAEAKAAAVPESVLRKRKREEQWAADKKEKALADRKKALESRKGIFARAKQYAEEYHAQEKELVQLTREAGGEGWVLCEPRGGAFCLGVASRGINAVRPRTREILQLLRLRETFRGVPGEGDRGGRRPAGRRGGAVGWRKGVRPAERRXRGGVAGRERWAGEGWARQRDSRCGNHRVAVGGGGCGGGASR

SEQ ID NO: 39766 - DNA, 763 bp, Zea mays
  misc_feature: Ceres CLONE 1430429-F
  misc_feature: Encodes the peptide sequence at SEQ ID NO. 39767
  misc_feature (293)..(293): n is a, c, t, g, unknown, or other
caagctggagctcaccgcggtggcggccgctctagaactagtggatcccccgggctgcaggaattcgcacgagaccattacctagaacatcctaatcgaaaaattcggcgactatggcggcggcaccggcaggcggcggccctcgggcattgtcccagcgggagcaggacatccagatgatgctcgccgccgatgtccaccctcggcacccaagaactgcgacttccaggtggagcgcctacctggccaagcaccccactgatgggagccaggtgattcacctgggggggacntgggacaagctccacgtggccggcagggcccacggtcgcgggcgacaaccgggaggacacctgttggcgggtcggcggcgccccccggggccgagggcgccgctacggcttcacggcggatcgggggaggaccggtgccgggggccggggcgggcccgtgcggggggtcaggccgcgcgggaggtgaggcggcgagcttgcccgggggccgcgcgctggccctatgcatggagggggtcatagaggcggattcggggggcgccagggggggaggctggcgcgtggggcgggcggggcggacgctccgagctggggtggaggaggaaagcggcgcgggcggggcagctgggatctggcgagctccgggcgggtgggggacgggggaagggccggagttgggtgggtggggggggggtgccgtcccgggaaaggtgtgtccgggctcgctgtgcggggagtgcggcgcgagg

SEQ ID NO: 39767 - protein, 140 aa, Zea mays
  misc_feature: Ceres CLONE 1430429-F
MAAAPAGGGPRALSQREQDIQMMLAADVHPRHPRTATSRWSAYLAKHPTDGSQVIHLGGTWDKLHVAGRAHGRGRQPGGHLLAGRRRPPGPRAPLRLHGGSGEDRCRGPGRARAGGQAAREVRRRACPGAARWPYAWRGS

SEQ ID NO: 39768 - DNA, 680 bp, Zea mays
  misc_feature: Ceres CLONE 1430431-F
  misc_feature: Encodes the peptide sequence at SEQ ID NO. 39769
ggagctccccgcggtggcggccgctctagaactagtggatcccccgggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacgggcaatgggaagcacagcgacatccccctcaaggactcgaagacgctttctcttcggcgagaagcccggtcaccgtctttggcatcaggaacccccaggagatcccgtggggtgagggttggtgcctaagtatgtccggaagcccaccgggggctttccctgacaaggacaaggctgctgccacatctgaagggggggggcccaaaaaggtttttttcccctgcccccaacaaagataggcccccgtgtttggttggggggggccaataaagaaaaaaaaccccccccccaagggtaaaaatttgttttcccaaaggggtagcggggccccccaaaa

SEQ ID NO: 39769 - protein, 132 aa, Zea mays
  misc_feature: Ceres CLONE 1430431-F
  misc_feature (4)..(117): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWEAQRHPPQGLEDAFSSARSPVTVFGIRNPQEIPWGEGWCLSMSGSPPGAFPDKDKAAATSEGGGPKKVFFPCPQQR

SEQ ID NO: 39770 - DNA, 686 bp, Zea mays
  misc_feature: Ceres CLONE 1430443-F
  misc_feature: Translation starting site: 201
  misc_feature: SWISSPROT Homolog: EC 5.3.1.1 Triose-phosphate isomerase
  misc_feature (400)..(400): n is a, c, t, g, unknown, or other
  misc_feature (403)..(403): n is a, c, t, g, unknown, or other
  misc_feature (405)..(405): n is a, c, t, g, unknown, or other
aaagctggagctccccgcggtggcggccgctctagaactagtggatcccccgggctgcaggaattcgcacgagaccattacctagaacatcctaatcgaaaaaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcacccctccttatgtcttccttcctgtggtcaagagccagctgcgccaagagttccatgttgcgggtgagaactnctngnttaagaagggacgtccctttcaccggtgaggtcagtgctgagatgctcttcaaccttggtgttccctgggtcatccttggacactctgaaaagagagctctgcctggaagaatcaaatgattttgttggagacaagggttgcgtatcccctggtctcagggactaaagggtatttgcatggtgttggtaagacccctggaacagaagggaggcggggtcccacccatggaggtttgttccctccccaaaacaaagcaatttgctgaaaaagatcaagggat

SEQ ID NO: 39771 - DNA, 631 bp, Zea mays
  misc_feature: Ceres CLONE 1430445-F
  misc_feature (274)..(274): n is a, c, t, g, unknown, or other
  misc_feature (278)..(278): n is a, c, t, g, unknown, or other
  misc_feature (281)..(281): n is a, c, t, g, unknown, or other
  misc_feature (291)..(291): n is a, c, t, g, unknown, or other
  misc_feature (306)..(306): n is a, c, t, g, unknown, or other
  misc_feature (307)..(307): n is a, c, t, g, unknown, or other
tggagctccccgcggtggcggccgctctagaactagtggatcccccgggctgcaggattcgcacgagacattacctagaacatcctaatcgaaaacacactgctcgttctcacgacaaattcgattcatcaaaatctacaaacgtagtagtatttacgagaatagatattacagggccaaacagctgctgcttctgttgaagcacgccgcaccggcagacgttacccctccattggcgaatgcagaacggagtacaggggcctgcccgacgccnatgncgnaggacgcggnacggtgcccgccgcnnctccgcaggtgtccatagtcccgctcgttttcctcatcttctacgaggtctccgggcggccccttccgcatcggagggacagcgtgggcccaacggggccccctcctcgccaatcctcggtttccttgtcctccccgtcatctggagcatcccggaagccctgattacccggaactgggccccttgtccccggaaaaacgcggggtaccctcggggtgggccccctttgggcctcgggccccctattggggaatccccacaaggggggggggggaaaaaggcctccaatgggggttttaacaaaaaaaaaggcccccgttcccc

SEQ ID NO: 39772 - DNA, 758 bp, Zea mays
  misc_feature: Ceres CLONE 1430446-F
  misc_feature: Encodes the peptide sequence at SEQ ID NO. 39773
  misc_feature (269)..(269): n is a, c, t, g, unknown, or other
  misc_feature (758)..(758): n is a, c, t, g, unknown, or other
ggagctccccgcggtggcggccgctctattctagtggatcccccgggctgcaggaattcgcacgagaccattacctagaacatcctaatcgaaaagccgcacccccaagacttccgtccgagtctgagctcatctccgcgcgctgccgccgccgccgccgccgctcgacgcccaccgcgcagccatggcggaacagactgagaaggctttcctcaagcagcctaaggtgttcctcagctcaaagaaatctggcaagggaaagaagccangcaacctggggcaagagaattggaagcggatcgagaccgccaagcattatccgggagctcctccgctggggttaccgcatcgagggcatctaccaccaccagaagtgcctccacctcggcgaccaagtacctagaggctacccgcggcgtgggttggggcaaggatgcccctcccgcctgaaaccccgcaagcccaagaagaccctcaaggcgcagtagcggcgctgctgcccttgcttctcgggctgttgttcccggattggagaagggagctgagcccttccattcgactcgaatgaaactggcctggaacttggggtcacttctccttttcccatccgaggccggctgataccacttaaaagtacagtgtttgttccaacaaaaaaactccctggagagggtcagagggtttgtcccgcaacgctgtgtgaaattgatgccaattccgctcggggtggaaaccggcgtgcctgcgggcatgtatcn

SEQ ID NO: 39773 - protein, 72 aa, Zea mays
  misc_feature: Ceres CLONE 1430446-F
  misc_feature (29)..(29): Xaa is any aa, unknown, or other
MAEQTEKAFLKQPKVFLSSKKSGKGKKPXNLGQENWKRIETAKHYPGAPPLGLPHRGHLPPPEVPPPRRPST

SEQ ID NO: 39774 - DNA, 668 bp, Zea mays
  misc_feature: Ceres CLONE 1430447-F
  misc_feature: Encodes the peptide sequence at SEQ ID NO. 39775
  misc_feature (359)..(359): n is a, c, t, g, unknown, or other
  misc_feature (547)..(547): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcncgacaaggagaggccgtggggggaatgctgcgacttggccgtatgcgtcaagacctacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacnacgaggaacggaggaagcggcgaccccctgacgacgacgctgggtggcaagcgacgccgacngcagtgatggcagatgaccagaaagcaagcgggcgcgacgacaacaagaaaaagaagcc

SEQ ID NO: 39775 - protein, 160 aa, Zea mays
  misc_feature: Ceres CLONE 1430447-F
  misc_feature (58)..(58): Xaa is any aa, unknown, or other
  misc_feature (121)..(121): Xaa is any aa, unknown, or other
MAMGAASILLMMVSLEALLLAAAAGGGTIRLPSDVGGVAADLVTAMARARARAKHQLXDKERPWGECCDLAVCVKTYPLTCSCFDRVERCSDACKECVETEDSRHVCVDRYRGDPGPRCHXEERRKRRPPDDDAGWQATPTAVMADDQKASGRDDNKKKK

SEQ ID NO: 39776 - DNA, 666 bp, Zea mays
  misc_feature: Ceres CLONE 1430452-F
  misc_feature: Translation starting site: 192
  misc_feature (205)..(205): n is a, c, t, g, unknown, or other
  misc_feature (237)..(237): n is a, c, t, g, unknown, or other
  misc_feature (258)..(258): n is a, c, t, g, unknown, or other
  misc_feature (278)..(278): n is a, c, t, g, unknown, or other
  misc_feature (281)..(281): n is a, c, t, g, unknown, or other
  misc_feature (351)..(351): n is a, c, t, g, unknown, or other
tggagctccccgcggtggcggccgctctagaactagtggatcccccgggctgcaggaattcgcacgagaccattacctagaacatcctaatcgaaaatctatcgcactcgtagtcgtagctcaagcatcagcggcaggagctctgggcagcgtgcgcacgtggggtacctagctcgctctgctagcctaccatggctgatcacancgggggtgcgacgggagggtgcgggggctacngcaacctccagcgcgggggcngcatgcacggcgaggcgcancancagcagaagcagggcgccatgatgacggcgctcaaggccgcgacggccgcgaccttcgggggtcgatgcntgtgctgtccgggctgatcctggccgggacgtgatccccctcacggtggccacccccgtgctggtgatcttcaccgggtgctggtggccgccgccatcccgctggcgctcatgggcggccggtttcgtcacctcgggcggcctcggcgtccctgcgcctgcccttgttcctcctgaattacaataacctgacgggaaacccccggcggggcgccaaccagctggaccccgcccagggggaggttgggttccaaggcccccaaaattcaggatgcagcacaccccccccatctaccggggggaggggttttaaaac

SEQ ID NO: 39777 - DNA, 635 bp, Zea mays
  misc_feature: Ceres CLONE 1430464-F
  misc_feature (285)..(285): n is a, c, t, g, unknown, or other
  misc_feature (286)..(286): n is a, c, t, g, unknown, or other
ggagctccccgcggtggcggccgctctagaactagtggatcccccgggctgcaggaattcgcacgagaccattacctagaacatcctaatcgaaaaaccccactccgccccacctccgcgcctcagatccatccccaaccggcaaccctagcgccgggttcctcctcctcggatccgcccgccgccgcgcggactccattgccagaggtgatcgaggggagagataacttggtggtcgattaggagagagggagggagatgtcagacgtcgttgacccagcggcnngtggcgacgggggtctgccgacagtcggagggctgttccacccccaagttaacgctcggcctccgtgcctacaattgccctagtcgcctggggggtcattcttctcggccccctatttaacaagggggtaagggtcggtaaagaattctccggggaaactggttccaaccaaaaaatctgtgacccagtctgaaaggtctttcccacccaaatttatgcggggggttcccatttttaaaaagggtttggaaaggcccctcaaaaaggttccccttgggccccccaaattttccccagatttttttatttttttaaaaaaaaaagggttaaactttgggagggggccccc

SEQ ID NO: 39778 - DNA, 660 bp, Zea mays
  misc_feature: Ceres CLONE 1430465-F
  misc_feature: Encodes the peptide sequence at SEQ ID NO. 39779
  misc_feature (286)..(286): n is a, c, t, g, unknown, or other
  misc_feature (371)..(371): n is a, c, t, g, unknown, or other
  misc_feature (394)..(394): n is a, c, t, g, unknown, or other
tggagctccccgcggtggcggccgctctagaactagtggatcccccgggctgcaggaattcgcacgagaccattcctagaacatcctaatcaaaaaattatattagtttggtagtttagtgacgctgaggcctcgtccccgatcagacttgttcggcctcttcgacggcgtgcccgtctccccgggctcattcgccatgcattcctcagcctccgcgagaggaggacgagggctcctcttgccggcggcggttgtggtgctactgtttggtgcagtggcgccagcngcgggttgctatccgcgcgtgtttcacttcggggactctctggcagacacgggcaactacccgttcgtctatggcaacggctcanccaagctccggtcaccatacggngagaccttcttcccacgcgccaccgggcgcgccctccacgggcgcctagtggtggacttcatcgcggacacactcggccctcccgttcgtgcgaccgtatctgagcggacggagcgcggaggacttcgcgggcgggggcaacttcccggggggcgcgccacggcgctcagcccggacttcttcggtgcaggggggtccacaccatgggaaaccgattggactccacatggagatgaggtggttccgcggctgctcgacctactctg

SEQ ID NO: 39779 - protein, 154 aa, Zea mays
  misc_feature: Ceres CLONE 1430465-F
  misc_feature: SWISSPROT Homolog: EC 3.2.1.51 Alpha-L-fucosidase
  misc_feature (59)..(59): Xaa is any aa, unknown, or other
MHSSASARGGRGLLLPAAVVVLLFGAVAPAAGCYPRVFHFGDSLADTGNYPFVYGNGSXKLRSPYGETFFPRATGRALHGRLVVDFIADTLGPPVRATVSERTERGGLRGRGQLPGGRATALSPDFFGAGGSTPWETDWTPHGDEVVPRLLDLL

SEQ ID NO: 39780 - DNA, 733 bp, Zea mays
  misc_feature: Ceres CLONE 1430466-F
  misc_feature: Encodes the peptide sequence at SEQ ID NO. 39781
  misc_feature (634)..(634): n is a, c, t, g, unknown, or other
agagctggagctccccgcggtggcggccgctctagatttactggatcccccgggctgcaggaattctcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagacgaagagcctgctgttggcgctcagcgtggcggcgctgctcgcggcgcagtcggactcccacggcctgggggacttcacgagcgggagcggcgaggcgacgacgacgccggagatgcagaccttcttcaagccccaggccgctgcggcgctcccggaggccctcgacgcctccatgcccgccaagccggaggcggcggcggcggcgctcccggccacgacaagggccggcacggcgccgtcagccacgccgcgcaggcccgtgtccgtggccgccggcgtggcctgcggcgtggcggccgtggccgtggccgggatcgctgccgccgtggcctacttggtgcgcggcgcgcggcgcgggacggaggtgcagctcggctcctccccgtgagccccgtccggccgggcccgnttgataagcccgtctccgtccgtaggaacttgggtaaaccccgttgtttaagcttttccatttttgggttttaagaaaatcttgcgacgggtttgcttt

SEQ ID NO: 39781 - protein, 133 aa, Zea mays
  misc_feature: Ceres CLONE 1430466-F
MACKTKSLLLALSVAALLAAQSDSHGLGDFTSGSGEATTTPEMQTFFKPQAAAALPEALDASMPAKPEAAAAALPATTRAGTAPSATPRRPVSVAAGVACGVAAVAVAGIAAAVAYLVRGARRGTEVQLGSSP

SEQ ID NO: 39782 - DNA, 649 bp, Zea mays
  misc_feature: Ceres CLONE 1430467-F
ggagctccccgcggtggcggccgctctagaactagtggatcccccgggctgcaggaattcgcacgagaccattacctagaacatcctaatcgaaaaattttcatttccccacctctctaaaaccctcgctcttgcccgctgttttacacctaaaagaaaggtcctcgccgtcgagccgccggctcccatctcccgcgccgtcgccgacgaggacacaccagacgcctcgctgatggccttggctcgcctcggacggtctcttgccggccgcctccaccgttctatctaccgtccaccggcgcccacagactaccatgcctccgtttcccgacccttcgctccgacccacacaggcgtatgcgtacgaggttttgcaagcttgacgtacaatgccagcagcatgattggccacaatctcgaggggccgttgccagtccacattgtgagggttctggatctcgtagtacatatgaatcctgctagaccgatgtcaacagcagcagcatcaaaggtgcctgttgggaccccggaagggtggcctgaaggttggccttgatgaggcctgggttcctaatttgagccgtaacagcccaggggaacgcctttcccttcctggaaaaaaagggtttaacccaaaggggctggggaa

SEQ ID NO: 39783 - DNA, 709 bp, Zea mays
  misc_feature: Ceres CLONE 1430471-F
  misc_feature (673)..(673): n is a, c, t, g, unknown, or other
aaagctggagctccccgcggtggcggccgctctagaactagtggatcccccgggctgcaggaattcgcacgagaccattacctagaacatcctaatcgaaaaagagttgtatgttgtagacgggcgagtgcgacgagcggagaacgtaatgccagcgctacaccgctgacgtgtccgccccggctccgggtgaaggtcaaaaggggcaaagggcggggggaaaccgtgggccctatatagcgggccttctcgctggagctaggagaaatcgccaagccaagccaagccagaagcggcagcctcgcgcagcggtctggtctctctggtgggtgcccctcttcgccggtggccggaaagggtagtggagtgggaccgctcaaggagaggccggcgtccccaagtctcacttccgccgtccgcttcccccctgggatcgagggaggaaggaaaggaggtgcttcacaatgaaggccctcattcttgtcggggggtttcggaaaccggccttccggccttttgaatctgaaacctttcccaaaaaccccccctggggatttttgcaaaacaccccccctttttttcttcccccccaaaaaaaaaaattttttttaaaaaaaagtggggggtgcccccacccgcgggggggggggtttttttttttttatttttttanccccccccccccccccccccggggagggaggtttta

SEQ ID NO: 39784 - DNA, 753 bp, Zea mays
  misc_feature: Ceres CLONE 1430477-F
  misc_feature: Translation starting site: 368
tccccgcggtggcggccgctctagaactagtggatcccccgggctgcaggaattcgcacgagaccattacctagaacatcctaatcgaaaaacaaacagatacagcccgtccattccccaatccccgtgtcgcctgtgcccctctgccacctcgccgtcggcatgacaacagggtcgaccccgggttcggccccctctcagagaaaacgaaattctaccaaggattccgttgccctgtacgcggtgcaatgctataagtgctacaaatggagtacggttccaaaagaagaatttgagacgcttcgtgaaaacttcactaaggatccatggttctgcagcagacgaccagacagctcttgtgaagacgatgctgacggtgaggtacgacagcagccgcatttgggttttggacaagcccaacataccaaagcctccaccagagacggagaggctatcggttatgaggggcgactacagcaaaatggacacattttatgccatgccctatgggtagcctgctaggtgtgctcggtgatgggataagtttctggacggcaaaccccgagtcccaagtaccccttatccggctttggtttcaagcttttgcgcccaccattccgtgcagtgcagaacactcctccctcaacgtccccttcgttgcccatcttttccctcttgctacctattctctgatcaaccgttaaatcgtcgcgactatccactaccgccctctcccctataccttctccttta

SEQ ID NO: 39785 - DNA, 790 bp, Zea mays
  misc_feature: Ceres CLONE 1430480-F
ccccgcggtggcggccgctctattactagtggatcccccgggctgcaggaattcgcacgagaccattacctagaacatcctaatcaaaactaacgctgtccgccgccacctctcctccggcatcgacgaggcgaaaccctagcgcccgagtccctctccctgctcccacaacccatggcggcggatatggcgtacgcgccgcctatgaacgctggcaaggccgggttctaggctcgcatgatggtatccccagcacatgatccgcatcacgctctcctccgagagcgtcaagaacctcgataaagcctgctggtaatcaggtgaaccgggccaagggtacatgggggctacgcgcctgcgctttccgtatgcgggccctgctcccccctccccctctagtccctccagtgatttggtgtcactggccacgggctgctgcacactagccggtggacaatcatgcgtatcaggggtggggcgtgcctccctatcggccgcgtactctgttcactctgctgacgtccgatggcgaccacctcgattgtggttttttgtcccccctgttctctcgggattgttctcgccgttctccccgcttaccgcttgctcgttccgcgcggcggtgcgtcgcgcttgtgggtcatgctcggtgtggtggggtggtgtagcctgcgtggatgagggtgaagcgcgcttgctctgccgtccctcctatggccccccttgctttacgcacgtcgtagtgggccttgttatctcgtacgtgtgaggtgtcgtactggctcgctgc

SEQ ID NO: 39786 - DNA, 733 bp, Zea mays
  misc_feature: Ceres CLONE 1430481-F
  misc_feature: Encodes the peptide sequence at SEQ ID NO. 39787
  misc_feature (397)..(397): n is a, c, t, g, unknown, or other
  misc_feature (472)..(472): n is a, c, t, g, unknown, or other
aagctggagctccccgcggtggcggccgctctagaactagtggatcccccgggctgcaggaattcgcacgagaccattacctagaacatcctaatcgaaaaatgcacactcactcactccagtgcccactgcccactgcccactgcccgacgaggaagtttcacgatcccaacccgtataaatcgacgccgcgagggggagcgacgagcgatccccgtaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcatttcactcccttcagaancactacgtcctcgtctactccctcatgatgtccggggactggctgcagggcccctacgtctactacctctacagncagtatggctttcgacagggggacatccgccgccctctcatcggcggctttcgaatcctccatgcttcttcggaaccatggtcggttcccttccccaacaacaggggcccaaaaagccctgcttcccttattggttaggttactccctcagtggatcacaaaaacttcccccaaaaaggggccctatgaaacggccccactccccggggggatcccccccttggtgttttttccccctttaaaaattgggtttttccccaa

SEQ ID NO: 39787 - protein, 110 aa, Zea mays
  misc_feature: Ceres CLONE 1430481-F
  misc_feature (40)..(40): Xaa is any aa, unknown, or other
  misc_feature (65)..(65): Xaa is any aa, unknown, or other
MEVFYYVVFGALAAVVAGLELGKSGKDRVATTSAFHSLQXHYVLVYSLMMSGDWLQGPYVYYLYXQYGFRQGDIRRPLIGGFRILHASSEPWSVPFPNNRGPKSPASLIG

SEQ ID NO: 39788 - DNA, 629 bp, Zea mays
  misc_feature: Ceres CLONE 1430482-F
  misc_feature: Translation starting site: 180
ggatcccccgggctgcaggaattcgcacgagaccattacctagaacatcctaatcgaaaaaggcacgacacgacacgagctcagccggcggcggcagagcgggaggagggagaacgcttcggtcccggtcccccccaacccaacctcctccccttcccgacgaggcgacgcgaagcgagatgccgctggacgactgcgtgctgctgctgaagactacggtgaccattgaggtcctagctcaactggagacgcagatggcgcgccgcgcattgccagcacatcgaggtcatcaccaacatctagtcattcggaaaggtcagtctcgcctacagcatcacgaagctctacagccgccacttcccagggccatcttatgctaacgaccatgatggttcccccttcgttcccgcaagatccccactatctgaaccaggaggacaaggtgcatcacatggctcgtcgatgaagcaaaaagacaccgaatacctggattgtagctcttagaccacggatagcgggcgagggacgagcttgaaaaactttcaaaccttgggcacacgcaaggggccacccacccatctttagaaattggcctcccattccacgaaaaactcccgggcaaactcccg

SEQ ID NO: 39789 - DNA, 827 bp, Zea mays
  misc_feature: Ceres CLONE 1430496-R
attgggtaccggggcccccctcgaggtcgacggtatcgataagcttttttttttttttttttcaaaaaaaacacgcaccggataactgataaatctcattccagtatcaagtttcttgccttctccacagacatcattccaagctgccctacactatcaaacagctcggccagatcctatctccacgaactaccctatgctgaacttgtaggctagacgtttcaatgttctatttcctctaggcaaaaatctaccaaaaaactttggagaaaaaaaagagagaatcaactgaagatcacagctgcgacgaccaggatcttggttgcgaggagtcggttgctccatccagcatcgccttgcgccgacgacttgctgttcaactcatgaacctgtggcttttgcctctccttcagtagaccacagtagagggcattgtccgggacgaccatctcggtgatgttgtagcccagtggatcggcaacctttccatagacctcctgccctctgtaccagtcatccagcctttcggcgcgcagattccagacacccaacgttggtcgaacgaaactaggaccgccgtccagccccccgggggaaaacctgagtcctgcaccgaagaaaatggcatccccccctggttggactcactccctcccggcccggtggtccaactcccccgtaaatccatccccgaacaaccaaagaaagggagttgccccatccaaaatggggtaggggtctgggaaccttccggggggtcccttttgtttccgggaaaacaccaaattctcccaggggaaaacccccctttggtataggaaacaccc

SEQ ID NO: 39790 - DNA, 732 bp, Zea mays
  misc_feature: Ceres CLONE 1430496-F
  misc_feature: Translation starting site: 185
ctggagctccccgcggtggcggccgctctagaactagtggatcccccgggctgcaggaattcgcacgagaccattacctagaacatcataatcgaaaaatgggatatggcagggacggaatccagatgaggatgaactcgtggcaggacggcgtcacgggcaccaactgccccatccctcccggatggaactggacctacgagttccagctcaaggaccagatcggcagcttcttctactacccgtctgtcggcctccatcgacaagccggggggtgcgctgccttcagttacaagactcccgcattgagctcctcccgctggagatgctccgcctcaaggccttccagcccatcctgggtggcggggccctccgggctcagggactcgacatgaggatccgcgtccgaggcggcgggaagacgtcgcagatctacgccattcgccaggccgtcgccaaggggctcgtcgcctactaccagaagttacgtcgacgaggccgccaagaaggaggtcaaggacatcttcacccggtacgaccgcacccttcttcgtcgccgaccccaggcgctgcgagccgaagaagttcggtggtcgcggcgcccgcgccaggttccagaagtcctaccgttgagcgctcggctgccggcgctttgcgtacggattgctgtgttgtcccaacttgccagttcgatgcctgtacccgtggcttaatttctatcatcggagctac

SEQ ID NO: 39791 - DNA, 783 bp, Zea mays
  misc_feature: Ceres CLONE 1430497-F
  misc_feature: Encodes the peptide sequence at SEQ ID NO. 39792
  misc_feature (166)..(166): n is a, c, t, g, unknown, or other
  misc_feature (774)..(774): n is a, c, t, g, unknown, or other
tcccctccttctcccccctcctcctcctttcccctccggccgttaaatgggagtccccccctgtggcggcgctctatactagtggatcccccgggctgcaggaattcgcacgagaccattacctagaacatcctaatcgaaaactcgttgtcttggcgagcagcgncggagcacggaggtgaaagaagagctgcggcagcaggcggcgccgaggagcggcatcccactcagtgcttgcaaccatggctaggggattaaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgaggatgccaagttcaagctctgcaaggtgaggtccgttcagtttggccagaaaggcatcccctacctgaacacctacgacggccgtaccatccgctaccccgacccgctcatcaaggccaacgacaccatcaagatcgatctggagaccaacaagatcatggacttcatcaagtttgacgtcngcaacgtgg

SEQ ID NO: 39792 - protein, 180 aa, Zea mays
  misc_feature: Ceres CLONE 1430497-F
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (178)..(178): Xaa is any aa, unknown, or other
MARGLKKHLKRLNAPKHWMLDKLGGAFAPKPSSGPHKSRECLPLILIIRNRLKYALNYREVISILMQRHVLVDGKVRTDKTYPAGFMDVISIPKTMENYRLLYDTKGRFRLHPIRDEDAKFKLCKVRSVQFGQKGIPYLNTYDGRTIRYPDPLIKANDTIKIDLETNKIMDFIKFDVXNV

SEQ ID NO: 39793 - DNA, 664 bp, Zea mays
  misc_feature: Ceres CLONE 1430505-F
  misc_feature: Translation starting site: 234
  misc_feature: SWISSPROT Homolog: EC 1.1.1.1 Alcohol dehydrogenase
ggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgaagcggcggtggcgtggggaccgggccagccactggtgatggaggaggtggaagtcgccccgccgggggcccatggagatccgtgtcaaggtcgtctccacctccgtctgccgcagcgacgtcactgcttggcaatccaagctgagagcctgaaacaacgatctctctgaacgatttgctctctgggtcccctccaattcaaaatgcaggcgcacttgatctgttcccaaaatcttcggcacaaaggatccggagtaataaaaggtgccgtaagggttcacccaatcccatttggggacccctctcccctggctttcttgggaaaacacaaaactcaaagccctgggttcccagaaaaaaaaaaatttgcccaaaaaccccgtcctggaaaaaa

SEQ ID NO: 39794 - DNA, 644 bp, Zea mays
  misc_feature: Ceres CLONE 1430559-F
  misc_feature: Encodes the peptide sequence at SEQ ID NO. 39795
  misc_feature (547)..(547): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggggcgggaccgactatgggacggacgacagcaagatctcccccgacgagatcctcttcgagggctgcgactacaaccactggctcatcaccatggacttcccggaccccaagccgtcgcgcgaagagatgatcgagacatacctccagactctcgccaaggtcgtcgggagttatgaggaggccaagaagaggatgtatggcntttttaanaacaaaaaatttgttgggttttccgggggttatggccccggaaaatgcccaaaaaattttcccggggtttttccccgccgaaaaaaaat

SEQ ID NO: 39795 - protein, 166 aa, Zea mays
  misc_feature: Ceres CLONE 1430559-F
  misc_feature (135)..(135): Xaa is any aa, unknown, or other
  misc_feature (137)..(137): Xaa is any aa, unknown, or other
MALALRLRRVLAAASTAAPLLRPSTSVARPCPLVPLASPVAPLPLPPWRFLPGGGAGFRSTAAAAARGGTDYGTDDSKISPDEILFEGCDYNHWLITMDFPDPKPSREEMIETYLQTLAKVVGSYEEAKKRMYGXFXNKKFVGFSGGYGPGKCPKNFPGVFPRRKK

SEQ ID NO: 39796 - DNA, 608 bp, Zea mays
  misc_feature: Ceres CLONE 1430560-F
  misc_feature (173)..(173): n is a, c, t, g, unknown, or other
  misc_feature (176)..(176): n is a, c, t, g, unknown, or other
  misc_feature (189)..(189): n is a, c, t, g, unknown, or other
  misc_feature (190)..(190): n is a, c, t, g, unknown, or other
  misc_feature (197)..(197): n is a, c, t, g, unknown, or other
  misc_feature (202)..(202): n is a, c, t, g, unknown, or other
  misc_feature (264)..(264): n is a, c, t, g, unknown, or other
  misc_feature (266)..(266): n is a, c, t, g, unknown, or other
  misc_feature (281)..(281): n is a, c, t, g, unknown, or other
  misc_feature (330)..(330): n is a, c, t, g, unknown, or other
aaagctggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgccctgtcatctcgatcgatncangggtggcgtgccnnagatgcngaccngccgtcgcttcctgctctcattattgctatcgcccgtcttttgctgcattactgccccgtgncnagctcgggctccccnggccgtgaaaaataacttccccgttggagaaggaaccggggttccaacnacaattcggggggcccccggttcctggaagggccccctaccctcccccatccccctttttccacaaaattttttctatgatttaacccccccccctttccccttgtaccttgttccccggggggggcaaaaaattgggtttttaaattttggggagggggggggggggaaaacccccccaaaatttcccgctctcccaaaaatctccccccgggttttttctgccccccctttggaaaaaaaaatcccctccccccccccctttatatagaaaccccc

SEQ ID NO: 39797 - DNA, 705 bp, Zea mays
  misc_feature: Ceres CLONE 1430561-F
  misc_feature: Translation starting site: 183
  misc_feature (191)..(191): n is a, c, t, g, unknown, or other
  misc_feature (230)..(230): n is a, c, t, g, unknown, or other
  misc_feature (276)..(276): n is a, c, t, g, unknown, or other
  misc_feature (306)..(306): n is a, c, t, g, unknown, or other
  misc_feature (308)..(308): n is a, c, t, g, unknown, or other
  misc_feature (314)..(314): n is a, c, t, g, unknown, or other
  misc_feature (320)..(320): n is a, c, t, g, unknown, or other
  misc_feature (353)..(353): n is a, c, t, g, unknown, or other
  misc_feature (356)..(356): n is a, c, t, g, unknown, or other
  misc_feature (363)..(363): n is a, c, t, g, unknown, or other
  misc_feature (364)..(364): n is a, c, t, g, unknown, or other
  misc_feature (369)..(369): n is a, c, t, g, unknown, or other
  misc_feature (372)..(372): n is a, c, t, g, unknown, or other
  misc_feature (395)..(395): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (427)..(427): n is a, c, t, g, unknown, or other
  misc_feature (438)..(438): n is a, c, t, g, unknown, or other
  misc_feature (447)..(447): n is a, c, t, g, unknown, or other
  misc_feature (464)..(464): n is a, c, t, g, unknown, or other
  misc_feature (475)..(475): n is a, c, t, g, unknown, or other
  misc_feature (482)..(482): n is a, c, t, g, unknown, or other
  misc_feature (483)..(483): n is a, c, t, g, unknown, or other
  misc_feature (509)..(509): n is a, c, t, g, unknown, or other
  misc_feature (550)..(550): n is a, c, t, g, unknown, or other
  misc_feature (595)..(595): n is a, c, t, g, unknown, or other
aaagctggagctccccgcggtggcggccgctctatactagtggatcccccgggctgcaggaattcgcacgagaccattacctagaacatcctaatcgaaaaaagacgatctgcgaaacaaacactagtgcgtttgcgagagaaaccgagaaagagaagctacagagtcactgaccgaccgctatggcatcnaggcagaacacgcgtgaggcgcgcgccgaggccgacgcncggcgcgccgtggaggagctggctcgggcgcaggacgagcacctcnagaaggcggaggggaacgcccgctcgggcncnaacaanatcgcncgctcccgcgccaaccggggggccgccggtggnggngggatcnntgganacntgccaggagggcggggggtcctnggccagcgccgggggggggaccttcnnnggcncccaggacgcnaccgtgganaagacctctcacacggntcacccaccgngggaccnnctcggcgaagcccggggccaacccgncgaaaagggccggggaggcccaacaacgcagcgtgctgcgnaacacggagcgagagggcggaagacaccccgcaacagacgggggntagtacaaggaccaccgccctggaaaagagggagtgagagcaaggactgcgtggggggagaaaaactggtcgagaacccggcacgggcacccgaacgaagcttagaaaga

SEQ ID NO: 39798 - DNA, 676 bp, Zea mays
  misc_feature: Ceres CLONE 1430564-F
  misc_feature: Encodes the peptide sequence at SEQ ID NO. 39799
aaagctggagctccccgcggtggcggccgctctatatctagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaaccagagctggaagatcctgccgtgg

SEQ ID NO: 39799 - protein, 171 aa, Zea mays
  misc_feature: Ceres CLONE 1430564-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEWCKGENQSWKILPW

SEQ ID NO: 39800 - DNA, 527 bp, Zea mays
  misc_feature: Ceres CLONE 1430576-F
  misc_feature: Encodes the peptide sequence at SEQ ID NO. 39801
aagctggagctccccgcggtggcggccgctctagaactagtggatcccccgggctgcaggaattcgcacgagaccattacctagaacatcctaatcgaaaaatcaagattcaagaatcaaaccaccattgaaatgaatactgaggaagaggaaggagtgaataagaggaagagaggagagatgggaagagggaagatcgagataaagaggatagagaatcggacatcaagacaagtgaccttctccaagagaagaagtggtcttatcaagaagactcatgagctctctgttctctgcgatgctcacatcggtctcatcgtcttctcccgcaccggaaagctcaccgagtactgctccgacccttccagatgcctcagctcattgagagatacctgcagaccaaacgattgcgacttcctgacctaatgacgggccaggagggaacgggacccgggagatttgaagtcctaaaaaaagagacttgtaagctttggacccccgtttggggtccaaaaccaggggaaatg

SEQ ID NO: 39801 - protein, 97 aa, Zea mays
  misc_feature: Ceres CLONE 1430576-F
  misc_feature (25)..(75): Pfam Name: SRF-TF Pfam Description: SRF-type transcription factor (DNA-binding and dimerisation domain)
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 2189 in the 10/666,642 US patent application
  misc_feature: The sequence is a functional homolog of SEQ ID NO 14 in the 10/666,642 US patent application
  misc_feature: The sequence is a functional homolog of SEQ ID NO 2193 in the 10/666,642 US patent application
  misc_feature: The sequence is a functional homolog of SEQ ID NO 4 in US patent 7303918
  misc_feature: The sequence is a functional homolog of SEQ ID NO 919 in the 10/666,642 US patent application
  misc_feature: The sequence is a functional homolog of SEQ ID NO 1949 in the 10/412,699 US patent application
MNTEEEEGVNKRKRGEMGRGKIEIKRIENRTSRQVTFSKRRSGLIKKTHELSVLCDAHIGLIVFSRTGKLTEYCSDPSRCLSSLRDTCRPNDCDFLT

SEQ ID NO: 39802 - DNA, 686 bp, Zea mays
  misc_feature: Ceres CLONE 1430579-F
  misc_feature: Encodes the peptide sequence at SEQ ID NO. 39803
aagctggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatgccatgaaccggcgagcccccctcggcgatattggcaacctcgtcagcgtccgcccagccgaagggaaact

SEQ ID NO: 39803 - protein, 61 aa, Zea mays
  misc_feature: Ceres CLONE 1430579-F
MPTRNHNAAAAAAPQHHHHNRGGAPALGKSKAVPGRADAMNRRAPLGDIGNLVSVRPAEGK

SEQ ID NO: 39804 - DNA, 673 bp, Zea mays
  misc_feature: Ceres CLONE 1430593-F
  misc_feature: Encodes the peptide sequence at SEQ ID NO. 39805
aagctggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattcg

SEQ ID NO: 39805 - protein, 145 aa, Zea mays
  misc_feature: Ceres CLONE 1430593-F
  misc_feature (58)..(145): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEISQTIDS

SEQ ID NO: 39806 - DNA, 670 bp, Zea mays
  misc_feature: Ceres CLONE 1430604-F
  misc_feature: Encodes the peptide sequence at SEQ ID NO. 39807
aagctggagctccccgcggtggcggccgctctagaactagtggatcccccgggctgcaggaattcgcacgagaccattacctagaacatcctaatcgaaaatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaaattcaagctttgcaaggttaggtctgttcaatttgggcagaaaggcatcccttatctgaacacgtatgacggccacaccatccgctaccctgaccccctcatcaaggccaacgacaccatcaagatcgatctggagaccaacaagattgtggacttcatcaagtttgatgttggcaacgtcgacatggtgactggcggaaggaacactggccgcgtgggtgttatcaagaacaggcagaaccacaagggcagctttgagaccattcacatggaggactccctgtgccaccagttacgcacccgtatgggcaacgtgttcaccatcggcaagggtaataagccgtgtgcg

SEQ ID NO: 39807 - protein, 171 aa, Zea mays
  misc_feature: Ceres CLONE 1430604-F
  misc_feature (29)..(105): Pfam Name: Ribosomal_S4e Pfam Description: Ribosomal family S4e
  misc_feature (112)..(146): Pfam Name: KOW Pfam Description: KOW motif
MQRHVLVDGKVRTDKTYPAGFMDVISIPKTNENYRLLYDTKGRFRLHPIRDEDAKFKLCKVRSVQFGQKGIPYLNTYDGHTIRYPDPLIKANDTIKIDLETNKIVDFIKFDVGNVDMVTGGRNTGRVGVIKNRQNHKGSFETIHMEDSLCHQLRTRMGNVFTIGKGNKPCA

SEQ ID NO: 39808 - DNA, 652 bp, Zea mays
  misc_feature: Ceres CLONE 1430607-F
  misc_feature: Encodes the peptide sequence at SEQ ID NO. 39809
ggccgctctataactagtggatcccccgggctgcaggaattcgcacgagaccattacctagaacatcctaatcgaaaaatttttgggtgagcatcccgggcaaaaccgaaggcgccaaagaagcttgctactgggagttctcgaccgatctccccctgaggagagagagagaccatgtccgacgaccaagtacgatcctgtgccggagtctgtgatctacaagatcatcgaggacttcagccgcggggactcgtcctcttactcctactaactccgactactggaagaagggctcctccgttggagtttgcggcggacgccttgaagggcaatatctaccacgttttcggaaacgagagggccgtggactaggtcctcggcggacccaatccccccacgctggttctatggaggaacaagaacatctcaggtgtggtacttggtggggcacctgccaatcatgctcatatttgaggtgctggagtaccgtctcctcatcttggtgtgacactgttctcgattcgctcgctggtcagtactgttcgggtgcgccggtggtcacccctttgggcatcaactaccccccagaacattgctggaggttggcatgagccctatcaagggagcctagtgaatgttctccctgtgaaat

SEQ ID NO: 39809 - protein, 65 aa, Zea mays
  misc_feature: Ceres CLONE 1430607-F
MSDDQVRSCAGVCDLQDHRGLQPRGLVLLLLLTPTTGRRAPPLEFAADALKGNIYHVFGNERAVD

SEQ ID NO: 39810 - DNA, 657 bp, Zea mays
  misc_feature: Ceres CLONE 1430614-F
  misc_feature: Encodes the peptide sequence at SEQ ID NO. 39811
  misc_feature (350)..(350): n is a, c, t, g, unknown, or other
  misc_feature (431)..(431): n is a, c, t, g, unknown, or other
  misc_feature (482)..(482): n is a, c, t, g, unknown, or other
  misc_feature (483)..(483): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (623)..(623): n is a, c, t, g, unknown, or other
tctgatctcgtggatcccccgggctgcaggaattctcacgagaccattacccagaacatcctaatcgaaaaacgcaataatggattatagtttgcttcttggcgttcatttccgggctcctcaaagcctacggacacaggcatcctttcatcaagcaatcctaccagataggctggctgttctttcagaagaaggtgctctggacgaggatgttttgaacagttctgaaggactggttttggttcagcgagctggggatgagagtgagctgtcatggggggccagagaggggggggccggtcttcggtgatcaaggcccggcgtggagggacccgagtctcttggttccnggggccgggggggctccccaaccacttggggggtaaactggccggacggtggcgaaagcccaggggtggaggtgtcttttnagtgaaaattcggcggacaggggcaggagggggggggggcctgttgggacnnactggatcctttgcccctgccgcccccgggggggaagaagagtggaacgggttggtgtgtgcttcgcgtgcgcnnnnngtgttccttttccggccctgcaaccatcagtttctcctcggaacggcacccttcaactcggngcgactctccgtgtgcccccaggtccgttttttt

SEQ ID NO: 39811 - protein, 29 aa, Zea mays
  misc_feature: Ceres CLONE 1430614-F
SDLVDPPGCRNSHETITQNILIEKRNNGL

SEQ ID NO: 39812 - DNA, 657 bp, Zea mays; identical to SEQ ID NO: 39810
  misc_feature: Ceres CLONE 1430614-F2
  misc_feature: Pfam Name: PIP5K Pfam Description: Phosphatidylinositol-4-phosphate 5-Kinase
  misc_feature: SWISSPROT Homolog: EC 2.7.1.68 1-phosphatidylinositol-4-phosphate 5-kinase
  misc_feature (350)..(350): n is a, c, t, g, unknown, or other
  misc_feature (431)..(431): n is a, c, t, g, unknown, or other
  misc_feature (482)..(482): n is a, c, t, g, unknown, or other
  misc_feature (483)..(483): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (623)..(623): n is a, c, t, g, unknown, or other

SEQ ID NO: 39813 - DNA, 506 bp, Zea mays
  misc_feature: Ceres CLONE 1430620-F
  misc_feature (181)..(181): n is a, c, t, g, unknown, or other
  misc_feature (183)..(183): n is a, c, t, g, unknown, or other
  misc_feature (198)..(198): n is a, c, t, g, unknown, or other
  misc_feature (199)..(199): n is a, c, t, g, unknown, or other
aaagctggagctccccgcggtggcggccgctctagaactagtggatcccccgggctgcaggaattcgcacgagaccattacctagaacatcctaatcgaaaaccgcctcccaccacctcgccattctccccctcccgcgccccgagaagcgctgcgggcctcacctgcccgtcctccctgncnctctcaggaaccgcnnggttcaggaagggaaggggaaaaggcaagtgccctgccggggggctcagcacccgatggggcgtacaagggcggaaggaacgactaacgactacccttcttcaaggggtcgtttctcattccggcgaaattcttggggttcgggaaaatccaaaccgggttttcccagggttccccccccaaacgaggttccgcccctaagaagttccaaagtcccaccccattcggggtccaaggtttcttaccaggaaaccatctaggggtccacaaaaaaaaagggccccaaagggccccataaatttggggaa

SEQ ID NO: 39814 - DNA, 607 bp, Zea mays
  misc_feature: Ceres CLONE 1430627-F
  misc_feature: Encodes the peptide sequence at SEQ ID NO. 39815
  misc_feature (304)..(304): n is a, c, t, g, unknown, or other
  misc_feature (370)..(370): n is a, c, t, g, unknown, or other
  misc_feature (371)..(371): n is a, c, t, g, unknown, or other
  misc_feature (460)..(460): n is a, c, t, g, unknown, or other
tggagctccaccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcangccatggaggtgcgcgtcaagatcctcttcacctcgctctgccacaccgacgtctacttctggganngccaggggcagactcccgtgttccctcggatctttggcacgagggctgaggtatcatagagagtgttggagagggtgtgactgacttanctcccggccgacctgtccctcctggtgtcactggggagtgcaaaggagtgtgcccactgcaagtcggcaaaaaagcaacttgtgtgatctgctcaagatcaccacccgaccccggtgttgataatttgccaaatggcaaattccccg

SEQ ID NO: 39815 - protein, 74 aa, Zea mays
  misc_feature: Ceres CLONE 1430627-F
  misc_feature: SWISSPROT Homolog: EC 1.1.1.1 Alcohol dehydrogenase
  misc_feature (33)..(33): Xaa is any aa, unknown, or other
  misc_feature (55)..(55): Xaa is any aa, unknown, or other
  misc_feature (56)..(56): Xaa is any aa, unknown, or other
MATAGKVIKCKAAVAWEAGKPLSIEEVEVAPPXAMEVRVKILFTSLCHTDVYFWXXQGQTPVFPRIFGTRAEVS

SEQ ID NO: 39816 - DNA, 637 bp, Zea mays
  misc_feature: Ceres CLONE 1430631-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (178)..(178): n is a, c, t, g, unknown, or other
  misc_feature (179)..(179): n is a, c, t, g, unknown, or other
  misc_feature (186)..(186): n is a, c, t, g, unknown, or other
  misc_feature (187)..(187): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (274)..(274): n is a, c, t, g, unknown, or other
  misc_feature (292)..(292): n is a, c, t, g, unknown, or other
nnnnnnnnnnnnnnnnnaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnngnnngnnnnnnnnnnnnnnggnnggggggnngnnnnnnnnnnnnnnnnnnnnnnnnnnnnnnnnnnnnnnnnnnnnnnnnnnnnnnnnnnnnnnnnnnnnccaaggctgggctccccncgggggcggccgctctanaactagtggatcccccgggctgcaggaattcgcacgagaccattacctagaacatcctaatcgaaaaacaacgacagccccagacaacactcaccgatagcaagtagcgccgccgacgtttcgagagcagagtatccaagctagccaagggggcacctgggtgactagctagttcaggcgacgatttgcgtcaggtcaggaaagcagggaagagcttggacgcagggccgccagggcaaaacgtcttccccggggggaaccggggggaaaaaaggttccaaggcccccaagaaaaaaccctttttccccaaagggggggaaacccccgggggaaggccccaaaaa

SEQ ID NO: 39817 - DNA, 665 bp, Zea mays
  misc_feature: Ceres CLONE 1430635-F
  misc_feature: Encodes the peptide sequence at SEQ ID NO. 39818
  misc_feature (665)..(665): n is a, c, t, g, unknown, or other
ggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgcaccgtcgcagn

SEQ ID NO: 39818 - protein, 108 aa, Zea mays; identical to SEQ ID NO: 16131
  misc_feature: Ceres CLONE 1430635-F

SEQ ID NO: 39819 - DNA, 584 bp, Zea mays
  misc_feature: Ceres CLONE 1430655-F
  misc_feature (80)..(80): n is a, c, t, g, unknown, or other
  misc_feature (287)..(287): n is a, c, t, g, unknown, or other
agctccccgcggtggcggccgctctagaactagtggatcccccgggctgcaggaattcgcacgagaccattacctagaancatcctaatcgaaaactcttctccaaaccccactcaccgcaacgagccgccggatccatggccggcaaagacggctccgtcccttccccgcctcctccccggctcccatcctaccctgagatgatcgtggaggcaatccgggcgctgggactcgagaacggctgcaaacagactgcgatctcggaactacatcagggggcagctacnggttcccaacctccctgcccagcacaacgccgtcctcacgggccacctcgcccgatgaaggctaccgggagctcgccttcctaggaacactattcctcccaaagaagaacagcctcccccttaacccccggtgggcaaagggccccccccccccccaaaaatccactgggcggtttggacctttgggacacaaattttttttttgtttcccccccccggaaagaaaacggtaaacccccgaaaattttaaggggccccgcccccccccccccctttgccccccccgaaagttcccac

SEQ ID NO: 39820 - DNA, 649 bp, Zea mays
  misc_feature: Ceres CLONE 1430659-F
  misc_feature: Encodes the peptide sequence at SEQ ID NO. 39821
aagctggagctccccgcggtggcggccgctctagaactagtggatcccccgggctgcaggaattcgcacgagaccattacctagaacatcctaatcgaaaaggttctgtttgtttggtgagatgtgttttcctctttctcctacgttgtgagtttccatttggtggacatccttttccagatcccttcgtggattagatccacgctcctctagtcgagatcgtcttgcatttttctgagatggagattgggaccgaaaaggttgcaaaacaatgacctccaactaatacaacccacaacagctgaagaagaaatccagctttctcaaccaccaaatttggaagacaagaccgttgaagagctgctcaacatagatccggatatgtttcccgaagaaggatgtactgttactatatcaagcatcgtgcaaaatagcagatggtggtacccatcttgctccaggtgccacaaatcttcatctcaaacctcaactggatatcactgcacatcatgtggctgcacaaatattaaatttagatacaagctcagcttcattgctactgatggaacatgcgaagcagagttcttttgttttgatagcatagccagaaaaatagtaggagaaccttggggcaaccttgttacagcag

SEQ ID NO: 39821 - protein, 89 aa, Zea mays
  misc_feature: Ceres CLONE 1430659-F
MFPEEGCTVTISSIVQNSRWWYPSCSRCHKSSSQTSTGYHCTSCGCTNIKFRYKLSFIATDGTCEAEFFCFDSIARKIVGEPWGNLVTA

SEQ ID NO: 39822 - DNA, 661 bp, Zea mays
  misc_feature: Ceres CLONE 1430668-F
  misc_feature: Encodes the peptide sequence at SEQ ID NO. 39823
tggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggagggcaagggggcgagagcgtgagtccaacgccggcgctcgggctgctctgcttccggaaggaagatgctgacgcgctgctggagcagatggatggcgatatgcgcgccggctctggtgtcgttcctgtcgcgctgaacaaggttatccaa

SEQ ID NO: 39823 - protein, 154 aa, Zea mays
  misc_feature: Ceres CLONE 1430668-F
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGGESVSPTPALGLLCFRKEDADALLEQMDGDMRAGSGVVPVALNKVIQ

SEQ ID NO: 39824 - DNA, 634 bp, Zea mays
  misc_feature: Ceres CLONE 1430670-F
  misc_feature: Encodes the peptide sequence at SEQ ID NO. 39825
  misc_feature (634)..(634): n is a, c, t, g, unknown, or other
gctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgcttccacccgtccgtcgcctctctgtcggctgcctgattgatttggttgccccggttccagcaatggcggtccaggcgcattatcaccaccactaccaccgcgagtcccctttcctcgtcagcggcgcgccggagggcagccggttggcggcagcgatggagctgcatcatcaggcgcagaaggaggctatggcgccgcaccaggctcgggcgccgcccctcttcttggacttctcgcatggagattacggcggccggaggaagccgcatcgcgaggcggagcccatgttctcgcagttcttctctctgcagcaacaaccgcaggcgcaggggcccaagggtgatcaacctgggcgcaacttccgaagccggacggggatgggccccccggcgtcgactttcaactaaggccttcggaaacagcgggtcatgccacatcccccggggcctccgggactcccgccctaatggtctccctcttctaan

SEQ ID NO: 39825 - protein, 114 aa, Zea mays
  misc_feature: Ceres CLONE 1430670-F
MAVQAHYHHHYHRESPFLVSGAPEGSRLAAAMELHHQAQKEAMAPHQARAPPLFLDFSHGDYGGRRKPHREAEPMFSQFFSLQQQPQAQGPKGDQPGRNFRSRTGMGPPASTFN

SEQ ID NO: 39826 - DNA, 689 bp, Zea mays
  misc_feature: Ceres CLONE 1430679-F
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacatttttctgagctngtgaactcctgcgcccgtctcctcgtcgaggacagaagatgagctcgctacacgcacacgagcggagcttggcctggtggtctgtacctaacaaaccgaaggccgggacagactgcagggcaatcaatacggttccaaatcgaaaaaacgggaacctggacttgcaaggaggtcaaagatccacaccttgg

SEQ ID NO: 39827 - DNA, 687 bp, Zea mays
  misc_feature: Ceres CLONE 1430683-F
  misc_feature (428)..(428): n is a, c, t, g, unknown, or other
  misc_feature (447)..(447): n is a, c, t, g, unknown, or other
aaagctggagctccccgcggtggcggccgctctagaactagtggatcccccgggctgcaggaattcgcacgagaccattacctagaacatcctaatcgaaaaattatctccctgactcgcctcgtcctccagatatcggccgccaccttcacctccaccgccccggcgcacctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtccccctccgtccgctctcacccaccgcttctatatcgccacctctctcngtgtagaagaagacactgnagatctggctttctggatcacatttcttgaggactatctggtggagaactaactagggtcctgtccatatatggatccgccagcctagattgagctgattttcttgaacaaatggacctttgaaggaaaaccttcccgggggggggtccaaaagggctaaaagagggtttggcatcctgaaaaagaaaaagggaagcccgtttgtttaaaaaagggtttcccagggcgggaaaaaaatgt

SEQ ID NO: 39828 - DNA, 606 bp, Zea mays
  misc_feature: Ceres CLONE 1430685-F
  misc_feature: Encodes the peptide sequence at SEQ ID NO. 39829
  misc_feature (56)..(56): n is a, c, t, g, unknown, or other
  misc_feature (57)..(57): n is a, c, t, g, unknown, or other
  misc_feature (418)..(418): n is a, c, t, g, unknown, or other
aaagctggagctccccgcggtggcggccgctctagtcaagacgcgacccccgggcnngcaggaatcccacaagaccattacctagaacatcctaatcgaaaaaaaaactccaactcaaacaacatgacacgctcctctagattccttggaactgagtcggcgccgccaccgccggaagaaatactagccgccgaaaccgacatgattgtgatactctcagctcttctctgcgctctcatatgcgtagccggcttagccgccgtagctcgatgcgcctggatccgccgtctggccggcgttaactcctccgccgtaggagaatctccgccgccgaacaaaggtctcaagaaaaaagcgcttcagtccctccctaagtcaaccttcacggccgcagactcgccgagctcctcctccgganagggagaatcaacctccgagtgcgccatatgcttaatggagttttcagacgggagagagatcaggatattacccttatgcagacacgccctccacgtggcgtgcatagataaggggggtgacctctcgggtcgtcgtgtcccttcttgtcgtaaaattttggttcccgggtgaagtggtgatccggga

SEQ ID NO: 39829 - protein, 155 aa, Zea mays
  misc_feature: Ceres CLONE 1430685-F
  misc_feature: The sequence is a functional homolog of SEQ ID NO 106 in the 10/374,780 US patent application
  misc_feature: The sequence is a functional homolog of SEQ ID NO 160 in the 10/225,068 US patent application
  misc_feature: The sequence is a functional homolog of SEQ ID NO 530 in the 10/225,066 US patent application
  misc_feature: The sequence is a functional homolog of SEQ ID NO 670 in the 10/666,642 US patent application
  misc_feature (99)..(99): Xaa is any aa, unknown, or other
MTRSSRFLGTESAPPPPEEILAAETDMIVILSALLCALICVAGLAAVARCAWIRRLAGVNSSAVGESPPPNKGLKKKALQSLPKSTFTAADSPSSSSGXGESTSECAICLMEFSDGREIRILPLCRHALHVACIDKGGDLSGRRVPSCRKILVPG

SEQ ID NO: 39830 - DNA, 703 bp, Zea mays
  misc_feature: Ceres CLONE 1430686-F
  misc_feature: Encodes the peptide sequence at SEQ ID NO. 39831
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatgccatgaaccggcgagcccccctcggcgatattggcaacctcgtcagcgtccgcccagccgaanggaaacctcagctgcaggagcag

SEQ ID NO: 39831 - protein, 67 aa, Zea mays
  misc_feature: Ceres CLONE 1430686-F
  misc_feature (60)..(60): Xaa is any aa, unknown, or other
MPTRNHNAAAAAAPQHHHHNRGGAPALGKSKAVPGRADAMNRRAPLGDIGNLVSVRPAEXKPQLQEQ

SEQ ID NO: 39832 - DNA, 721 bp, Zea mays
  misc_feature: Ceres CLONE 1430687-F
  misc_feature: Encodes the peptide sequence at SEQ ID NO. 39833
  misc_feature (35)..(35): n is a, c, t, g, unknown, or other
  misc_feature (78)..(78): n is a, c, t, g, unknown, or other
  misc_feature (79)..(79): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
gaatggcggccccccgcccggcgcggagtcgccgnggaagggggacgtagagccccccggggggggaggggggggggnngggnnnnggggaaactggcgctccaccgcggtggcggccgctctattactagtggatcccccgggctgcaggaattcgcacgagaccattacctagaacatcctaatcgaaaaagcaccaggtgcttcacgggttcatcatcactccgctagccagacagctactggcctacagctagccgcctcctctcctctcatcccatcccatgtcatgaccgacaagcgaagcagagcactggcatgagcatggaccgcatggcgcggcgttccgtgtccttgctcctcgctctggatctcctggccgccgcggcgtcggcggactcgtggctgtacgagaagttcacgacggagggcaacgtgcgcgcggactacaacgcgcaggggcagcaggtgacggcgcggatcctgacgcaacactccggcggcgccttcagctcgcggcagaagtacctgcacggggagctcaacatccagatgaggctgatcccgggcaactccgcgggcaccgtgacctccttctacctgtacgcccggcgacgggccccggcacgaaggagatcgacgtgggagttcatggggcaccgccaggcgggcacgcccgtggggctcgaaacaccaacgtggggggccccacgggcggacg

SEQ ID NO: 39833 - protein, 134 aa, Zea mays
  misc_feature: Ceres CLONE 1430687-F
  misc_feature: SWISSPROT Homolog: EC 2.4.1.207 Xyloglucan:xyloglucosyl transferase
MSMDRMARRSVSLLLALDLLAAAASADSWLYEKFTTEGNVRADYNAQGQQVTARILTQHSGGAFSSRQKYLHGELNIQMRLIPGNSAGTVTSFYLYARRRAPARRRSTWEFMGHRQAGTPVGLETPTWGAPRAD

SEQ ID NO: 39834 - DNA, 697 bp, Zea mays
  misc_feature: Ceres CLONE 1430689-F
  misc_feature: Encodes the peptide sequence at SEQ ID NO. 39835
aaagctggagctccccgcggtggcggccgctctagaactagtggatcccccgggctgcaggaattcgcacgagaccattacctagaacatcctaatcgaaaaaagaaaataggagcagcttcacctcggaagctcagactcaatggttggtgcgaaggggtgtgagagatgcagggactggcaggagcactactactgggagcatatggatgcgagcaagatccgcttcttcaggtgcatgacaggagactttgctcatcgcattagcgtgccagagaagttcgcaaagaacttcaaggggcagatcaccgaagagtttcacctgaaatcacctagcagcgctgagacatggcacgtcggtgtagagaagcatggcgacaaactattcctcgtgtcagggtgggagaatttcgccaaggctcatgagctggaggagaacgatctcctgctcttcgcttgctctggaaactcttcctttgaggtcctagtcttcggagcaagtggctgtgagaaagtgtcatccctgtttggcagtggacttggtccggacatgggcaaacaattcaatgatgtggtgcgtcgacatggtgtgcatcactctgtgactgtgagtgattctgaggataccgttgcgccgtcccagctggttcgatcccctcgtaacgccttgcctttgaaggaacccagtgggaaggct

SEQ ID NO: 39835 - protein, 185 aa, Zea mays
  misc_feature: Ceres CLONE 1430689-F
  misc_feature (28)..(122): Pfam Name: B3 Pfam Description: B3 DNA binding domain
MVGAKGCERCRDWQEHYYWEHMDASKIRFFRCMTGDFAHRISVPEKFAKNFKGQITEEFHLKSPSSAETWHVGVEKHGDKLFLVSGWENFAKAHELEENDLLLFACSGNSSFEVLVFGASGCEKVSSLFGSGLGPDMGKQFNDVVRRHGVHHSVTVSDSEDTVAPSQLVRSPRNALPLKEPSGKA

SEQ ID NO: 39836 - DNA, 870 bp, Zea mays
  misc_feature: Ceres CLONE 1430693-F
  misc_feature (11)..(11): n is a, c, t, g, unknown, or other
  misc_feature (12)..(12): n is a, c, t, g, unknown, or other
  misc_feature (23)..(23): n is a, c, t, g, unknown, or other
  misc_feature (24)..(24): n is a, c, t, g, unknown, or other
  misc_feature (74)..(74): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (870)..(870): n is a, c, t, g, unknown, or other
gggtgtggggnncgggttggggnntggggccgcggttctgcgccgccgtggttgcgggagggcgcccctgtggnttttgcnnnnnnnnaaaactggcgctccaccgcggtggcggccgctctatactagtggatcccccgggctgcaggaattcgcacgagaccattacctagaacatcctaatcgaaaaacaccgtatcccacaacctccgagctcagcttagctccactccagctccaatcgcaatcgtgaccagagcgcgagagctagctagagggtcgtgaaaatgttgatcaataagatcgccctgtggagtcacgaggaggtgtaccacccgggggccctctaggcggcggttgcgggagttcatgtccaccctcatccttctctcccccggccagggggtccgggattgggctgtcacaaggtcgacccgccgtgtgggccacccaacccctcgggatccctgaatctggggggggggggggggggggggggagtcccgagctggtccggtgggccatggtaaggcggtgtggccgaacggttcttccctgccgcgggcggccttgaaaacccgtgagcccggtgactctttaagccggtcttttagtaggagacctgctgagtcagccaccccctggttgccctgcgggtggtttcgtggcccgcctcgtggggggcgagccccttcttcccggggcggacgccccgcggtgccccctccatcccccctttttcctccgcccccctctataagcggggggggggttcgttcggcgctaactttccccgggtcggcaacgtacccccccccccctcagtcagagagcccctcgcgtagcccccgcaagtctcggtgtctcctn

SEQ ID NO: 39837 - DNA, 662 bp, Zea mays
  misc_feature: Ceres CLONE 1430698-F
  misc_feature: Encodes the peptide sequence at SEQ ID NO. 39838
  misc_feature (537)..(537): n is a, c, t, g, unknown, or other
  misc_feature (633)..(633): n is a, c, t, g, unknown, or other
aagctggagctccccgcggtggcggccgctctagaactagtggatcccccgggctgcaggaattcgcacgagaccattacctagaacatcctaatcgaaaaaccgagaaacaaaaattgaaggaaattgaaggggccgcagtgcagcaggacgatggtcagaacagtgaagacgggtggacctggttcagtagacccagcgtgagtactctcgcgccactcgcctccgcgtccgccaccgccttctccaccacacgccccactgcgtacaggccttgcttggactggtactgcatccaaagcaatgttagtagaacacacacacacacacgcatatgtgtatccgttacgtgctagtagcatgcagtacagtacctgagaggtgtatcttggaacgacccacgtctcgagcttgagcttgtggagcctgttggcctcggacctgaaggcggtccgggtccggccgaggagcgcggccagcgggcacgccaccgccgccgccagaagcctgctgctgctgctgctgcaggcgccgtancgggacgcgggcggcgccggcgcggcggcgagggacgcaaccaagccccaaagcgggaagagggaggcccgcctgtttaagtgcctgaagtggacnaacgtcggccgcgtcctccccgatgcggc

SEQ ID NO: 39838 - protein, 117 aa, Zea mays; identical to SEQ ID NO: 12563
  misc_feature: Ceres CLONE 1430698-F

SEQ ID NO: 39839 - DNA, 817 bp, Zea mays
  misc_feature: Ceres CLONE 1430700-F
  misc_feature: Encodes the peptide sequence at SEQ ID NO. 39840
  misc_feature (74)..(74): n is a, c, t, g, unknown, or other
  misc_feature (75)..(75): n is a, c, t, g, unknown, or other
  misc_feature (78)..(78): n is a, c, t, g, unknown, or other
  misc_feature (79)..(79): n is a, c, t, g, unknown, or other
gttggggtgggtttttggggggttcccccctggggggcgcgggttggggcggggggggggggggccccaggcgnnttnnaaaatggagctccccgcggtggcggccgctctttactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcagtgctcacaagctcctatagcttcgcttcttcccccgtacctctcaccagtggtgtcttcggtatgtcaaaacccaattcttgaagcctacaggatccaagaggcaacccccggctgggatcttagcctttatcaccccttgttccgcgggggggggggcgggcctgatgccagcagcttacccttttggcccatttaatcggcagcaaacccatcaccgccaccaccgactgcccgacagctttggggctaaccagaacgtgggctggcctgcctcgtcggcaacgccgcggctttcctgaccgtaccacccaaggtaggcctggagtgcaacctcgcccccccccgggaggttggggggtggctattaaaccgacccacttccagcccccccccaatctagtctgggccttaccgccgcgggcggcatgttttttctcttgtgccgacaccaaactcggcggccgcgcggggaaacctgctgccctggggtttggacttgac

SEQ ID NO: 39840 - protein, 67 aa, Zea mays
  misc_feature: Ceres CLONE 1430700-F
  misc_feature (25)..(25): Xaa is any aa, unknown, or other
  misc_feature (26)..(26): Xaa is any aa, unknown, or other
WGGFLGGSPLGGAGWGGGGGGPRRXXKWSSPRWRPLFTSGSPGLQEFARDHYLEHPNRKIAHIIETN

SEQ ID NO: 39841 - DNA, 704 bp, Zea mays
  misc_feature: Ceres CLONE 1430702-F
  misc_feature (393)..(393): n is a, c, t, g, unknown, or other
tggagctccccgcggtggcggccgctctagaactagtggatcccccgggctgcaggaattcgcacgagaccattacctagaacatcctaatcgaaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgggtacatgtgacgatgcacttaaacttctctgcagtgctttcggatgtcaaatagaagagataacattaccagagctttgagagatgcgtactgctcatngtgtctcaattggctcaaaatcatcctgtgacttggatcctccttacaaggcaggaagaaaaactgaggttacctttggatacctcaaacagtttggcactttttggggctttccccggccactgaattaggtggcctccccaaatataaggggggaggaaaaggctttttcccctgggaaactttcaaaaaggggaaatgttaaacaaccccccaaacagggggatttccgcccccaaaaaaccccccaaaggtccttaaaaacggggaaaacaaaatatttttggggcccccttcaataggggcgttta

SEQ ID NO: 39842 - DNA, 683 bp, Zea mays
  misc_feature: Ceres CLONE 1430713-F
  misc_feature: Translation starting site: 453
  misc_feature: SWISSPROT Homolog: EC 1.14.17.4 Aminocyclopropanecarboxylate oxidase
aaagctggagctccccgcggtggcggccgctctagaactagtggatcccccgggctgcaggaattcgcacgagaccattacccagaacatcctaatcgaaaaatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtaagcagagcaccaacgaatgcttgcaattaatatttgacaacttctttccatatgcatgcgcgcgggcgtacgtacgtcattatgatgcgccggcgccgctcgcatccgcatcgcaggtggagaaccacggcgtggacgcgccgctgatggacgaggtcaagcgcttcgtctacggccactacgaggagcacctggaggccaagttctacgcctccgccctcgccatggacctcgaggccgccaccagaggtgacactgatgagaagccctccgacgaggtggactgggagtccacctacttcatccagcaccaccccaagaccaacgtcgccgacttcccagagatcacgcccgcgacacgagagacgctggacgcg

SEQ ID NO: 39843 - DNA, 702 bp, Zea mays
  misc_feature: Ceres CLONE 1430716-F
  misc_feature: Encodes the peptide sequence at SEQ ID NO. 39844
  misc_feature (520)..(520): n is a, c, t, g, unknown, or other
  misc_feature (601)..(601): n is a, c, t, g, unknown, or other
  misc_feature (618)..(618): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaaatcgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaaggccgccgcggcggcggcggcggcggcggcggcgaagcctgccacgagggcgtacgtgacgttcctggcgggcgacggcgactactggaagggcgtggtggggctggccaagggcctccgcaaggtccgctcggcctaccccctggtggtggccgtgctgcccgacgtgcccgagtcccaccgccgcatcctcgtctcgcagggctgcgtcgtccgcgagatcgagcccgtgtacccgcctgagaaccagacgcangtcgccatggcgtactacgtcatcaactactccaagctccgcatctgggaagtcgtggagtacgagaggatggtgtacctnggacgcgacatccaggntgtcgaggacatcgacggcctggtcgagctcgagaaggggtacttctacccgtgatggactgcttctgcnaaaaaactggagcc

SEQ ID NO: 39844 - protein, 148 aa, Zea mays
  misc_feature: Ceres CLONE 1430716-F
  misc_feature: SWISSPROT Homolog: EC 2.4.1.186 Glycogenin glucosyltransferase
  misc_feature (98)..(98): Xaa is any aa, unknown, or other
  misc_feature (131)..(131): Xaa is any aa, unknown, or other
MAPELMTAKMTAKAAAAAAAAAAAKPATRAYVTFLAGDGDYWKGVVGLAKGLRKVRSAYPLVVAVLPDVPESHRRILVSQGCVVREIEPVYPPENQTXVAMAYYVINYSKLRIWEVVEYERMVYLGRDIQXVEDIDGLVELEKGYFYP

SEQ ID NO: 39845 - DNA, 706 bp, Zea mays
  misc_feature: Ceres CLONE 1430726-F
agagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccggcgccacctgccactaccctactcaaccgccccgggctcagcctcatccccagccaccaccatgcccgtgccaacagccggattccaagccccgtgccagcttcaggggaaccctggggcgttgggagcccccccgatcccgggcccagggcggcccagttcccggagggatttattggagccccgaggggggaaaccccttatgggtcccccctcaaggtccaagtcctttggcggccacccatggttttcccagcacctcttagggggggggggggaccccccacccccccccgc

SEQ ID NO: 39846 - DNA, 756 bp, Zea mays
  misc_feature: Ceres CLONE 1430727-F
  misc_feature: Encodes the peptide sequence at SEQ ID NO. 39847
  misc_feature (304)..(304): n is a, c, t, g, unknown, or other
  misc_feature (339)..(339): n is a, c, t, g, unknown, or other
  misc_feature (353)..(353): n is a, c, t, g, unknown, or other
aaagctggagctccccgcggtggcggccgctctagaactagtggatcccccgggctgcaggaattcgcacgagaccattacctagaacatcctaatcgaaaaacctataatattttgagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttccctccaccagttactttcatggncttcgaacacccagctgtgcaagcctataggctancacaagcgattgcngcgagcgtcttacaacaaccaattgccaatttgcacaacatcccttggacatctaacatacaaaccatccaaaccaacagcaaacacagttcctacagcactgagccacctagcctttgggaaccttggcccctacttgaaaaaggagtggtttgatccaaacccctttgcttttaaaaagtgtttggaaacccggaaaaaaaaaaacactggcaaagtttttccccccccttttaccaaaaaccccgggggaaaccccccgcccccaactaaaaaaaaaaaaaaagatgtttttttttttacccccccctctttggggccaaatcccctcttatttttcgaaaacaaaaatttttgccacaaaaattcccccccccccaccccctcctgggggggaaaaacc

SEQ ID NO: 39847 - protein, 113 aa, Zea mays
  misc_feature: Ceres CLONE 1430727-F
  misc_feature (46)..(46): Xaa is any aa, unknown, or other
  misc_feature (58)..(58): Xaa is any aa, unknown, or other
MATKILSLLALLALFASATNASIIPQCSLAPSSIIPQFPPPVTFMXFEHPAVQAYRLXQAIAASVLQQPIANLHNIPWTSNIQTIQTNSKHSSYSTEPPSLWEPWPLLEKGVV

SEQ ID NO: 39848 - DNA, 700 bp, Zea mays
  misc_feature: Ceres CLONE 1430730-F
  misc_feature: Encodes the peptide sequence at SEQ ID NO. 39849
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgcgccgctctcggtcatgaaattggtgat

SEQ ID NO: 39849 - protein, 156 aa, Zea mays
  misc_feature: Ceres CLONE 1430730-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFGTGMYAAPLSVMKLV

SEQ ID NO: 39850 - DNA, 709 bp, Zea mays
  misc_feature: Ceres CLONE 1430731-F
  misc_feature: Encodes the peptide sequence at SEQ ID NO. 39851
  misc_feature (709)..(709): n is a, c, t, g, unknown, or other
aagctggagctccccgcggtggcggccgctctagaactagtggatcccccgggctgcaggaattcgcacgagaccattacctagaacatcctaatcgaaaaagaaccaccacaaaacctgctcctagctgctctcgtgtgttttgttacatccaatattaagcgagagcgggctagctataggtaagaccgtaagaggatgatggtggacaggcagcgcgtgaggcaatgcgacattgaggtcatgaagatggccatgctcaagcacgaagaaaccttcaggcagcaggtccacgagctgcatcgcctgtaccgtatacagagggagctgatgacaatgacgacgagtgacgacctgaccggagccaagccggtgaccaccccccgccggcgcagcaagcagccgcggcgggcgctgccgctgggcctgcagctcccggccgacgagtacatagccagcgccgacgaggatgaggacgccgccgccggcacggagctggagctgacgctcgccgtcggtgggcgctgctcacccgccggccgtcgcaagagcgacaggaggaggaggaggcaagcagcagagcctcgcgacgacgccggcgccgtctcctcccccttcgggcccgactgctctggcgcgagcgtcctgtcgtcgccttcgtcggccgagtactgctccgatgacgggcctgcggcggcggttcacgcgn

SEQ ID NO: 39851 - protein, 170 aa, Zea mays
  misc_feature: Ceres CLONE 1430731-F
MMVDRQRVRQCDIEVMKMAMLKHEETFRQQVHELHRLYRIQRELMTMTTSDDLTGAKPVTTPRRRSKQPRRALPLGLQLPADEYIASADEDEDAAAGTELELTLAVGGRCSPAGRRKSDRRRRRQAAEPRDDAGAVSSPFGPDCSGASVLSSPSSAEYCSDDGPAAAVHA

SEQ ID NO: 39852 - DNA, 701 bp, Zea mays
  misc_feature: Ceres CLONE 1430733-F
  misc_feature: Encodes the peptide sequence at SEQ ID NO. 39853
aaagctggagctccccgcggtggcggccgctctagaactagtggatcccccgggctgcaggaattcgcacgagaccattacctagaacatcctaatcgaaaaaccctcccccatttttcccttggttggccgtcccctctcctcccatggcagccgcccaccatttcttcctcctccatagatctccccctcccccatgcagcaaggatcgagaagaggaggagcaagatggattgaagaggaagagaggatcaaggagatgttctacccccccatctattgcagattttcttggggaaactctaggtacttgattcatgttgggaatgaggggagtagcagcacgtccaccttcactctcataataacgctgcccaggcacaaccatgatttaattagaaacttcttgtcaaaggatgtttgtctttaactagtcatgcacactagttaattcaattcatgtcgttatggttatcttctcattgctagccgattattaatgtctattatgttttcttatcatgatatctgcttatactctgttgcttccacgtttatgcaaattttcaaaggagatgctgtcaaaattttatatatgaatgttagttgtgtagtttagtagcatttcaggatgtttgtggatcctggggtgttacagaagacgagagctataatattgctttcaacaacctacgaacaga

SEQ ID NO: 39853 - protein, 55 aa, Zea mays; identical to SEQ ID NO: 16588
  misc_feature: Ceres CLONE 1430733-F

SEQ ID NO: 39854 - DNA, 678 bp, Zea mays
  misc_feature: Ceres CLONE 1430735-F
  misc_feature: Translation starting site: 168
tggagctccccgcggtggcggccgctctagaactagtggatcccccgggctgcaggaattcgcacgagaccattacctagaacatcctaatcgaaaaattgcactgatcgtcttcctcgagttctcctctaccaaattttaagtcacatgcggcaaagctctcggtgatgtgtggccgccgcaaaggctgtaagggtctgggcaagggtggcaccaaatcccaccgcagggtgctgcgtgacaacatgcaggcatcaccaagccagcaatcccctcgttggcaaggaggggccgcatcaagcgcatctccgggctcatctacaaagagacccgcggcctgctcaagatccttcctcgagaacgtcatccgcgacgtcgtcacctagagcgagcacgcccgccacaagaatgagaccgccatgcacgttgactacgctctcaagcgccaggggcgcaccctctacggttaccgctgctagatcgcccctctcccggtggccaattacgtgctggcggtggcggactgccttgtgttcttggtctagttactctacgtagtctgtatcgcagctgtctcctgtggtggacgtactgcatcgttctgccttctgatccatgatgcagtaatatctcgctgctgtactgaatggaatgtcactcgcttctagcccccagaag

SEQ ID NO: 39855 - DNA, 664 bp, Zea mays
  misc_feature: Ceres CLONE 1430746-F
  misc_feature (624)..(624): n is a, c, t, g, unknown, or other
aaagctggagctccccgcggtggcggccgctctataactagtggatcccccgggctgcaggatattcgcacgagaccattacctagaacatcctaatcgaaaaaaaagctataaataacgctgcgcatgcctgtgcacttctccatcaccaccactgggtcttcagagcattagctttatctactccagagcgcagaagaacccgatcgacaccatgagggtgttgctcgttgccctcgctctcctggctctcgctgcgagcgccacctccacgcatacaagcggcggctgcggctgccaaccaccgccgccggttcatctaccgccgccggtgcatctgccacctccggttcacctgccacctccggtgcatctaccaccgccggtccacctgcccccaccagtccacctgccaccgccagtccatgtgccgccgccagttcatctgccgccgccaccatgccactaccctactcaaccgccccggcctcagcctcatccccaggcacacccatgcccgtgccaacagccgcatccaagcccatgccaactgcaagtaacctgcggccttagcagcaccgcgatcctgggccactgcgtcaagttcctgaagcatcagtgcancccaacggcgacgccctactgctcggctcagtgccagtcc

SEQ ID NO: 39856 - DNA, 416 bp, Zea mays
  misc_feature: Ceres CLONE 1430752-F
  misc_feature (287)..(287): n is a, c, t, g, unknown, or other
  misc_feature (289)..(289): n is a, c, t, g, unknown, or other
aagctggactccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggcttgcgggcttgccagcccaccgccggccgggttcatctaccngncgcccggtggcattctgcccaccctcccgggtcacactggccccccctccggggggatttctccccaccccggcgggggcccccctttgccccccccccccggggtccccctttgggcccccccccg

SEQ ID NO: 39857 - DNA, 704 bp, Zea mays
  misc_feature: Ceres CLONE 1430758-F
  misc_feature: Encodes the peptide sequence at SEQ ID NO. 39858
  misc_feature (472)..(472): n is a, c, t, g, unknown, or other
  misc_feature (473)..(473): n is a, c, t, g, unknown, or other
  misc_feature (499)..(499): n is a, c, t, g, unknown, or other
ggagctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgccgctcctcgccacgctgcggtccggcccgcggttctctggtgtgcaaacccatgttgcccgctgtgaaacagcagttgtaaagatgctacgaagctggaagctccagttttgtgttgtacaggtgccctctagaggattgaaanngcactgctctagcccttgaaaagcangatgcaaggtctggtaaatatgctcggtcttcgaaagagctgaagaggtctccaagagattgagcatctggtggtgaagctatcacctttggagagatgttcaaaagagctgatgtaaatctatgatgaagcgctctagataatggggacgataatgtgcttgtaataatgcaggattacccagaccttttatgatgaagatgaa

SEQ ID NO: 39858 - protein, 58 aa, Zea mays
  misc_feature: Ceres CLONE 1430758-F
MAAAAAAAAAVSSPIAPRAVAAAASRRGFVTFGGGAAAPRHAAVRPAVLWCANPCCPL

SEQ ID NO: 39859 - DNA, 707 bp, Zea mays
  misc_feature: Ceres CLONE 1430760-F
  misc_feature: Encodes the peptide sequence at SEQ ID NO. 39860
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacagcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgactgcgtcgcacgcgctgacggtggcgacgctgttcccgctgggcgggctgctgctggtgctgtcggggctggcgctgactgcctccgtggtggggctggccgtggccacgccggtgttcctgatcttcaaccccgtgctggtccccgccgcgctgctcatcgggacggccgtcatggggttcctcacgtcgggcgcgctggggctcgagggcctgtcctcgctcacgtgcctcgccaacacggcgcggcaagcgtaccatcgcaccccggactacgtggaggaggcgcaccgcacgatggcggatgccgcagcgcacgcgggccacaagaccgcgcaggcatgccaggccatccagggcagggcgcacgagg

SEQ ID NO: 39860 - protein, 167 aa, Zea mays
  misc_feature: Ceres CLONE 1430760-F
  misc_feature (44)..(161): Pfam Name: Oleosin Pfam Description: Oleosin
MADRDRSGIYGGAHATYGQQQQQGGGGRPMGEQVKGMLHDKGPTASHALTVATLFPLGGLLLVLSGLALTASVVGLAVATPVFLIFNPVLVPAALLIGTAVMGFLTSGALGLEGLSSLTCLANTARQAYHRTPDYVEEAHRTMADAAAHAGHKTAQACQAIQGRAHE

SEQ ID NO: 39861 - DNA, 748 bp, Zea mays
  misc_feature: Ceres CLONE 1430767-F
  misc_feature: Encodes the peptide sequence at SEQ ID NO. 39862
aaagctggagctccccgcggtggcggccgctctagaactagtggatcccccgggctgcaggaattcgcacgagaccattacctagaacatcctaatcgaaaaaacctctgacgatcaccatcgccgctagcctccaccaccaacttcccatcgcctccccctcatctccccacactcctgacctcacctctccgaactgcagcacctcccctcccgccacccacacgtgctcccatggccgccaccgcgatctcagtccgcctccacccaaccgccgcgcgccatgtggcctccgcccgccgcgcccgcctcggggccgtccgcgcgcagtccgcgccggcggcggcggcggccgcgctgacgcaggacaacctccagcggctggcggccgtgcgcgccctcccagcaggtggaagagcgggatggtgctcgggctccgggacgggctccacgggccccctttccccgtcgcccaaaatcggcgccgctcttggcccccgggcaaacctccaaaaagaatgttcgggtgttccccaactcccaaagcccaccctttaaagaaaggccccagtcgctttgggaatatcccgttttctccagtttggagaaaaaaacccggttatatagacccccccccttttaagggggccccacaaaaggttgaacccctaaaccccccaccctttttaaaaaggggcgggggggggccccctccccccccttaaaaaaaatggttttaaaaccaccc

SEQ ID NO: 39862 - protein, 107 aa, Zea mays
  misc_feature: Ceres CLONE 1430767-F
MAATAISVRLHPTAARHVASARRARLGAVRAQSAPAAAAAALTQDNLQRLAAVRALPAGGRAGWCSGSGTGSTGPLSPSPKIGAALGPRANLQKECSGVPQLPKPTL

SEQ ID NO: 39863 - DNA, 722 bp, Zea mays
  misc_feature: Ceres CLONE 1430769-F
  misc_feature: Translation starting site: 156
  misc_feature: Pfam Name: Ribosomal_L5_C Pfam Description: ribosomal L5P family C-terminus
tccccgcggtggcggccgctctagaactagtggatcccccgggctgcaggaattcgcacgagaccattacctagaacatcctaatcgaaaaatctcctccacccagccgccgccgccgcctaaggagaagagggtccggccgtctccttgccccgatggcgtccgagaagaagcagtccaacccgatgcgggagatcaaggtgcagaagctggtcctcaacatatccgtaggggagagcggcgaccgcctcacctcgcgccgccaaggtgctggagcagctcagcggccagacccccgtcttctccgaggcgaggtacacggtgcgctcgttcggcatccggcgtaacgaggagatcgcctgctacgtcacggtcaggggcgacaaggccatgcagctgcttgagagcggcctcaagggtcaggagtacaagctgctcaggatgaacttcagcgacaccgggtgcttcgggttcggcatccaggagcacatcgaccctgggtatcaagtatggatccatcaacaggcatctatggggatgggctttctacctttgtgctcgagggttgttggttaacccgcttcgcgcgcccccagggagggtgcaagcccccggggttggcgattccagcataagggggaaccaagggaggaacttccctggaagggggtttccagggtacaggttccgaaagggtgttcattccttccaaaagaggtgtc

SEQ ID NO: 39864 - DNA, 668 bp, Zea mays
  misc_feature: Ceres CLONE 1430775-F
  misc_feature: Encodes the peptide sequence at SEQ ID NO. 39865
agagctggagctccccgcggtggcggccgctctagaactagtggatcccccgggctgcaggaattcgcacgagaccattacctagaacatcctaatcgaaaaaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaaggtatggatctcgctcgccttactcgagaagcacaaggtaccgaagtcgctctaggagtgtcgactctagtgatgctgaaaaccctgggaacaacctgtatgtgactggtttgtcagctcgtgtaacggatcgagatctggagaagcacttctccactgagggtgaggtgattgatgcaagcgttgtatatgatccttggacaagggaatcacggggttttggttttgttaccatggctgctgttaaagatgcagatcgctgcatcaaatatctggaccgttctgtgttgcaaggtcgggtcataactgttgagaagattttgttgacagcaacagggtagatgttggtagctgctctgcaacaaactgatacaacctaacaccaaaccatgccaacctcagccaaagggttgtatgccctacattgcaaaga

SEQ ID NO: 39865 - protein, 120 aa, Zea mays
  misc_feature: Ceres CLONE 1430775-F
  misc_feature (40)..(111): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSYSRGSRYGSRSPYSRSTRYRSRSRSVDSSDAENPGNNLYVTGLSARVTDRDLEKHFSTEGEVIDASVVYDPWTRESRGFGFVTMAAVKDADRCIKYLDRSVLQGRVITVEKILLTATG

SEQ ID NO: 39866 - DNA, 728 bp, Zea mays
  misc_feature: Ceres CLONE 1430777-F
  misc_feature: Translation starting site: 167
  misc_feature (527)..(527): n is a, c, t, g, unknown, or other
  misc_feature (532)..(532): n is a, c, t, g, unknown, or other
  misc_feature (534)..(534): n is a, c, t, g, unknown, or other
  misc_feature (558)..(558): n is a, c, t, g, unknown, or other
  misc_feature (559)..(559): n is a, c, t, g, unknown, or other
  misc_feature (569)..(569): n is a, c, t, g, unknown, or other
  misc_feature (633)..(633): n is a, c, t, g, unknown, or other
  misc_feature (641)..(641): n is a, c, t, g, unknown, or other
  misc_feature (643)..(643): n is a, c, t, g, unknown, or other
ctggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaaccagcccttcaccctacaggctccacaagcaatcgcaaacagcaactacctttatcacccctgtttctttcacatcgccagccctatctttggtgcagtcattggtacaaacccatcagggcacacagctgcagcaactcgtgctaccagtgatcagccaagtagctctgggcaacctttctccctactctcagcaacaacattttctccanttcancnactgtctacactgaaccctgctgnnctattgcagncacacaactactaccattcagccagctagctactgcctactctcagcagcaacaatttcttccnatttaacnanttcgccgcactgaaccccctctgcttatttccagcagcaaatactactaccatttggccagctagctacaccaagccccggcttc

SEQ ID NO: 39867 - DNA, 708 bp, Zea mays
  misc_feature: Ceres CLONE 1430783-F
  misc_feature: Encodes the peptide sequence at SEQ ID NO. 39868
  misc_feature (434)..(434): n is a, c, t, g, unknown, or other
  misc_feature (535)..(535): n is a, c, t, g, unknown, or other
aagctggagctccccgcggtggcggccgctctagaactagtggatcccccgggctgcaggaattcgcacgagaccattacctagaacatcctaatcgaaaatgctggagttggaatgagggcatcagctgcttacatctacattagaggtgaatacgtgaatgagcgtctcaaccttgagaaagctcggcaggaagcgtatgcagctggacttctgggtaagaatgcttgtggctctggttatgattttgatgtgcatattcattttggtgctggtgcgtacatctgtggtgaagagaccgccctactagagagccttgaagggaagcagggcaaacctaggctgaagccacctttcccagccaatgctgggctctacggctgcccccacactgtgactaatgtaaaaactgtggctgtatccccaaacattcnttaggcgcgtccagaatggtttgcagctttgggcgcaagaaccactcttggaaccagctctattgcatctcagggcatgtgaaacaacccttgcacggggnaaaaaggaaatgacctacttcttaaggaattgcccaaaaggcctttggagggtgaaaaaggggaatggaaaaaccttgtttggggaatatcggggggggtcttcttgtcccctttttgcaaaccaatatgggaagaagggggaagggcctaaaacccccgagggggtgcaaac

SEQ ID NO: 39868 - protein, 106 aa, Zea mays
  misc_feature: Ceres CLONE 1430783-F
  misc_feature (1)..(108): Pfam Name: Complex1_51K Pfam Description: Respiratory-chain NADH dehydrogenase 51 Kd subunit
  misc_feature: SWISSPROT Homolog: EC 1.6.99.5 NADH dehydrogenase (quinone)
MRASAAYIYIRGEYVNERLNLEKARQEAYAAGLLGKNACGSGYDFDVHIHFGAGAYICGEETALLESLEGKQGKPRLKPPFPANAGLYGCPHTVTNVKTVAVSPNI

SEQ ID NO: 39869 - DNA, 676 bp, Zea mays
  misc_feature: Ceres CLONE 1430785-F
  misc_feature: Encodes the peptide sequence at SEQ ID NO. 39870
tggagctccccgcggtggcggccgctctagaactagtggatcccccgggctgcaggaattcgcacgagaccattacctagaacatcctaatcgaaaactctctgtcgcatttcccgtcctgtccttcccttacccggcggcttaaaccctagttctcactcccatcgccgcttcagctccgccgcagcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacacatacaatttgatctggttttcgataaagagtttgagctgtcgcacacatcaaaaactaccagcgtcttcttcactggctacaaggttgagcagccattcgaggaagatgaaatggatcttgattctgaagatgaagacgaggagcgggatgttccagtagtcaaggaaaatggcaaagctgatgggaagaaacagaaaagtcaagaaaaggcagttgctgcaccttcaaaatcaagtccggattccaagaagagcaaggatgacgatgattctgatgaggacgagactgatgattct

SEQ ID NO: 39870 - protein, 162 aa, Zea mays
  misc_feature: Ceres CLONE 1430785-F
MEFWGLEVKPGSTVKCEPGYGFVLHLSQAALGESKKSDNALMYVKIDDQKLAIGTLSVDKNPHIQFDLVFDKEFELSHTSKTTSVFFTGYKVEQPFEEDEMDLDSEDEDEERDVPVVKENGKADGKKQKSQEKAVAAPSKSSPDSKKSKDDDDSDEDETDDS

SEQ ID NO: 39871 - DNA, 716 bp, Zea mays
  misc_feature: Ceres CLONE 1430788-F
  misc_feature: Encodes the peptide sequence at SEQ ID NO. 39872
  misc_feature (395)..(395): n is a, c, t, g, unknown, or other
  misc_feature (420)..(420): n is a, c, t, g, unknown, or other
  misc_feature (451)..(451): n is a, c, t, g, unknown, or other
  misc_feature (497)..(497): n is a, c, t, g, unknown, or other
  misc_feature (505)..(505): n is a, c, t, g, unknown, or other
  misc_feature (554)..(554): n is a, c, t, g, unknown, or other
  misc_feature (560)..(560): n is a, c, t, g, unknown, or other
  misc_feature (567)..(567): n is a, c, t, g, unknown, or other
  misc_feature (577)..(577): n is a, c, t, g, unknown, or other
  misc_feature (578)..(578): n is a, c, t, g, unknown, or other
ggagctccccgcggtggcggccgctctagaactagtggatcccccgggctgcaggaattcgcacgagaccattacctagaacatcctaatcgaaaatctcccgcagagcagccgacaactctctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcanggcgacgaggatcaagcttacaggnaaatcaggctccgtgctgaagatgtgcaggncaggaatgtgctcacaaacttttggggtatgaattttaccactgantaattgangtccctagtgaagaagtggcagacattaatcgaagcccatgttgatgtncagacnaccgacnactacatgtnntgcgttggtctgcatcggcttcacccagaggcgcccaaacccagtcaagagaacctgctatgctcaggcatcccagatccgtcagatccgccgtaggatggtgaagatatgatcaccaggcttctactgtgacctgaa

SEQ ID NO: 39872 - protein, 107 aa, Zea mays
  misc_feature: Ceres CLONE 1430788-F
  misc_feature (11)..(107): Pfam Name: Ribosomal_S3Ae Pfam Description: Ribosomal S3Ae family
  misc_feature (74)..(74): Xaa is any aa, unknown, or other
  misc_feature (83)..(83): Xaa is any aa, unknown, or other
  misc_feature (93)..(93): Xaa is any aa, unknown, or other
MAVGKNKRISKGKKGGKKKTVDPFSKKDWYDIKAPSVFSVRNIGKTLVSRTQGTRIASEGLKHRVFEVCLADLXGDEDQAYRXIRLRAEDVQXRNVLTNFWGMNFTT

SEQ ID NO: 39873 - DNA, 756 bp, Zea mays
  misc_feature: Ceres CLONE 1430794-F
  misc_feature: Encodes the peptide sequence at SEQ ID NO. 39874
  misc_feature (344)..(344): n is a, c, t, g, unknown, or other
  misc_feature (365)..(365): n is a, c, t, g, unknown, or other
  misc_feature (367)..(367): n is a, c, t, g, unknown, or other
  misc_feature (373)..(373): n is a, c, t, g, unknown, or other
tggagctccccgcggtggcggccgctctagaactagtggatcccccgggctgcaggaattcgcacgagaccattacctagaacatcctaatagaaaaaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcnagggagtgcgggtggaggacncnatgacngctgccgagcgcagccccttctaactctacagcaagccacagatccctcgcaactttcgcgccctacgggatgctctccaggggctccgtccatccatcgggatgcccgggagggccaaaacaacttcccggggtaacgttcctggtggaacttgggtgggggcccttcctttctaggggaaaaaagtcccaaccccccctcgggggggattcaccccccccgggggttttttatgggaagggggaaacccccccaaccttttaaattgcccgtggaaggggaatttttttaaagggggggaccgtattttttttttagaaatttttccacacccgccaaaccccgggaaaaaagaggcctttttttttaaaaaaaaaaaagg

SEQ ID NO: 39874 - protein, 96 aa, Zea mays
  misc_feature: Ceres CLONE 1430794-F
  misc_feature: SWISSPROT Homolog: EC 4.1.1.20 Diaminopimelate decarboxylase
  misc_feature (80)..(80): Xaa is any aa, unknown, or other
  misc_feature (87)..(87): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCXGVRVEDXMTAAERSPF

SEQ ID NO: 39875 - DNA, 759 bp, Zea mays
  misc_feature: Ceres CLONE 1430796-F
  misc_feature: Translation starting site: 199
  misc_feature (588)..(588): n is a, c, t, g, unknown, or other
ctacaactagtggatcccccgggctgcaggaattcgcacgagaccattacctagaacatcctaatcgaaaaatctgattctgatcgcaccgccgtcggcccaccgcttcagttggcagttgcgagtggctccaacaatccaccggcaccaacccagcgcggcgccaccggcgacccgtaccccctcccccggagagcgatggcgacggagctgacggcggcgcagctgcgcgcgtacgacggcaccgacccgtccaagcccatctacgtctccgtccgggggcaggtctacgacgtcacctccggccgcggtttctacggtcccggcgggggcctacgccgtcttcgcgggccgcgagggggggcgcgccctcggcaagatgtccaaggaccagggcccacgtctcccggggacctcctccgggctcacccaccaagaagctcgggggcccccgcccaaatgggagaatcaatttccaggcccaaataccccggtcgtccccccgaattcgccgcccgacgcctggaattcgggaagggcccgggcaaaaaatttacccccgtccctgcccccctggggggggttcantggcctgtggctgcgcttggcttgttgggcaaaattgggttttggctcccccaataaaccctgaatgggaaggggccctatctggatgtgggcccggcgggaaaaaatatcccaaaggcccttggcacaccccctgcctgctggctacccccattgtaaattgaagtgtca

SEQ ID NO: 39876 - DNA, 731 bp, Zea mays
  misc_feature: Ceres CLONE 1430797-F
  misc_feature: Encodes the peptide sequence at SEQ ID NO. 39877
  misc_feature (249)..(249): n is a, c, t, g, unknown, or other
  misc_feature (259)..(259): n is a, c, t, g, unknown, or other
  misc_feature (262)..(262): n is a, c, t, g, unknown, or other
  misc_feature (263)..(263): n is a, c, t, g, unknown, or other
  misc_feature (278)..(278): n is a, c, t, g, unknown, or other
  misc_feature (279)..(279): n is a, c, t, g, unknown, or other
  misc_feature (424)..(424): n is a, c, t, g, unknown, or other
  misc_feature (510)..(510): n is a, c, t, g, unknown, or other
  misc_feature (550)..(550): n is a, c, t, g, unknown, or other
  misc_feature (551)..(551): n is a, c, t, g, unknown, or other
  misc_feature (556)..(556): n is a, c, t, g, unknown, or other
  misc_feature (581)..(581): n is a, c, t, g, unknown, or other
aaagctggagctccccgcggtggcggccgctctagaactagtggatcccccgggctgcaggaattcgcacgagaccattacctagaacatcctaatcgaaaaatcatcgctcgctcttctcttggtcttgcaactccagtgctgctcactgccactgccagcagatcgagctgctccgcctcactagccctcttgctttgctgctgcacctgcaagtctgcaaccgcgcacagagagatgtcgacggtngagccgtgcngtnnccctcgaccagaagnnctcgccctcgccaagcgctgctccccgagaagcgaccctcgccggaagcaaagcggcagcggtggcgactatcgcctccgcgatccccaccctggccagcgtgcggatgctgccatgggccaaggccaacatcaacccccacggnccagcgctcatcgtctccacggtggctgggatggcatacttcatcgccgccgacaagagatcctgtcgctggcgaagcgccactcngtcgagcagcccctgagcacctcagaacacctccttcagnngcacngccgtcccccaccggctttcttcangccgtgagacgtggcctccgtcgagctagctacctacccctctttcagtcgatcgtcagtgcaagcacccaccatgcctgaataattttaatttatctacgaagctagctgctgaacatcgatctgctagtatactacggcgaagctgct

SEQ ID NO: 39877 - protein, 46 aa, Zea mays
  misc_feature: Ceres CLONE 1430797-F
  misc_feature (42)..(42): Xaa is any aa, unknown, or other
MLPWAKANINPHGPALIVSTVAGMAYFIAADKRSCRWRSATXSSSP

SEQ ID NO: 39878 - DNA, 718 bp, Zea mays
  misc_feature: Ceres CLONE 1430810-F
  misc_feature: Encodes the peptide sequence at SEQ ID NO. 39879
  misc_feature (277)..(277): n is a, c, t, g, unknown, or other
  misc_feature (498)..(498): n is a, c, t, g, unknown, or other
  misc_feature (576)..(576): n is a, c, t, g, unknown, or other
  misc_feature (577)..(577): n is a, c, t, g, unknown, or other
  misc_feature (601)..(601): n is a, c, t, g, unknown, or other
  misc_feature (635)..(635): n is a, c, t, g, unknown, or other
aagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtnagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataaagcatatgcgccgcgcgtcgaagcttagtgtctgatcgatacgctatccctacaattttctgagctngtgaactcctgcgcccgtctcctcgtcgaagacaggagatgagctcgctacacgccacacgaagcgagcttgggctgnntgtcctgtacctgaacaaagccgngccccgggacagatctgcagggcgaatcagtacngcttcaagttcgtaagcaaacggcagcctgccactgcgcaggaagtcgacagatcgacccactttgctcgcaaagtcttccgg

SEQ ID NO: 39879 - protein, 37 aa, Zea mays
  misc_feature: Ceres CLONE 1430810-F
  misc_feature (14)..(14): Xaa is any aa, unknown, or other
  misc_feature (22)..(22): Xaa is any aa, unknown, or other
MSSLHATRSELGLXVLYLNKAXPRDRSAGRISTASSS

SEQ ID NO: 39880 - DNA, 722 bp, Zea mays
  misc_feature: Ceres CLONE 1430817-F
  misc_feature: Translation starting site: 218
aagctggagctccccgcggtggcggccgctctagaactagtggatcccccgggctgcaggaattcgcacgagaccattacctagaacatcctaatcgaaaatgccagtccactcctaccccactcagaatcggagagccgcggaacatacgctggctaaggcgaaggtgtgacggaacgagcaccagccatggtgcacgtcaacttctaccgaacctatgctaggacgttcaacaaactcaaggcgtccttatgacaaggagcgtcttgatgctgacctcaagctggtctgcgaatatgggctgaggtccaagctcgagctttgaagggtccagtgtagcatctgagcaggatacgtactgctgccagggacttgctcatccttgacgacaagaacccccgtcgtatctactgagggtgaggcgcttcttcgacacatgaagcgctctgggctgcttgactgagggtcagaacaagcttgattatgctcttgccctcgccgctgataacttcctcgcaaggcggcttctgacacttgtcttcaaggctggcatgccagatggattcaacatgctcgcgtcttgatcaatcatcgtcacatctcgattggtaggaaacatcgtcacagcccatcattcatggtcagcgtggactctgaataactgcatgactcttctctgtcgagcaccatctagtggacgcaccggctgaggggtgacgaca

SEQ ID NO: 39881 - DNA, 692 bp, Zea mays
  misc_feature: Ceres CLONE 1430826-F
  misc_feature (309)..(309): n is a, c, t, g, unknown, or other
  misc_feature (329)..(329): n is a, c, t, g, unknown, or other
  misc_feature (330)..(330): n is a, c, t, g, unknown, or other
  misc_feature (421)..(421): n is a, c, t, g, unknown, or other
  misc_feature (423)..(423): n is a, c, t, g, unknown, or other
  misc_feature (424)..(424): n is a, c, t, g, unknown, or other
tggcggccgctctagaactagtggatcccccgggctgcaggaattcgcacgagaccattacctagaacatcctaatcgaaaacaagacaaatccaaccaaccaagctattccccatctccggaccagcgccgcctccagtcgctgtccacgggcaccccgggcgcgcctcctccgagcccagactcgagctccatcccgccgtggatcaccgcgtgaggtggggcgcaccgaccggaccccggagggccagatggtgtccggcgccggagggggcgagtagcgcggtcggcggccacgaaacgattggncgcggcgcggcgaggcgtcnngtcgagcgggggccaccatgtctgctgtagtgtgcggcaagaggtcctcctcccatctcggcgacgagcttgtaccttccccttcctcccntnncgtcccttccccacacatcaccccggcaagaggggccgctgctccccgtccgctgggagggaggtctactccacccactcctcaccctcttcccggaaatggatccccagttacttgaaaaagctcttgagggctctggagatgacttgaactctgcaataagagattaaaccagctgcgactggagtcagctgggggctatctatctgccactgtttgtgaatctgaggaggaatatcctcacctcataacttattggctgaaagta

SEQ ID NO: 39882 - DNA, 720 bp, Zea mays
  misc_feature: Ceres CLONE 1430830-F
  misc_feature: Translation starting site: 205
  misc_feature (336)..(336): n is a, c, t, g, unknown, or other
  misc_feature (345)..(345): n is a, c, t, g, unknown, or other
  misc_feature (459)..(459): n is a, c, t, g, unknown, or other
  misc_feature (517)..(517): n is a, c, t, g, unknown, or other
  misc_feature (525)..(525): n is a, c, t, g, unknown, or other
  misc_feature (634)..(634): n is a, c, t, g, unknown, or other
  misc_feature (642)..(642): n is a, c, t, g, unknown, or other
  misc_feature (650)..(650): n is a, c, t, g, unknown, or other
  misc_feature (677)..(677): n is a, c, t, g, unknown, or other
  misc_feature (690)..(690): n is a, c, t, g, unknown, or other
  misc_feature (709)..(709): n is a, c, t, g, unknown, or other
  misc_feature (710)..(710): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacngcgtcgcangcgctgacggtggcgacgctgttcccgctgggcgggctgctgctggtgctgtcggggctggcgctgacggcctccgtggtggggctggccgtggccacgccggtgttcctgatnctcagccccgtgctggtccccgccgcgctgctcatcgggacggccgtcatgggttccntcacgtcnggcgcgctggggctcgggggcctgtcctcgctcacgtgccctcgcacacggcgcggcaggcgttcagcgcaccccggactacgtggaagaagcgcacccgcagatggcngaaagcgncgcccacncgggccacaagacgcgcaggcaggcangccatccaggcanggcccaggaagccgccccnngggaggtgcc

SEQ ID NO: 39883 - DNA, 677 bp, Zea mays
  misc_feature: Ceres CLONE 1430831-F
  misc_feature: Encodes the peptide sequence at SEQ ID NO. 39884
  misc_feature (677)..(677): n is a, c, t, g, unknown, or other
ggagctccccgcggtggcggccgctctagaactagtggatcccccgggctgcaggaattcgcacgagaccattacctagaacatcctaatcgaaaaaagtaatccatttctcctttccttcgtctcttccttccattctcctcctcatcaactccatcgcattgctattccagtcctcgccagagaagaatcccgcgagcgagcgagcgcgcgaggcggcaaggacgagcccaagacgtacgatggcgaggaggctggcgtacacgacggcgctgaccacgctcttcagctacgggctgctcttcgccttcggccagctcagggatctcttccgccacctgctcggctgcttcagacccaacaaggacgacgacgtcaagcaggggtacgcgccgatctgcgtcggcctggaggatttcttcgtgcgacgactctacctgcgggttcaggattgcttcggcaggccaatcgctagcgcaccggactcatggttcgatgtggtggagcgtacctcagacgacaacaacaagacattgcagcgcacctcaaagaccactagatgcctgaacctgacgtcctacaactacctcgggttcgccgcggccgatgagtactgcgtcccacgcgttgtcgactccctcaagaaatactcggcgagcacctgcagtgctcgtgtn

SEQ ID NO: 39884 - protein, 145 aa, Zea mays
  misc_feature: Ceres CLONE 1430831-F
  misc_feature: SWISSPROT Homolog: EC 2.3.1.50 Serine C-palmitoyltransferase
MARRLAYTTALTTLFSYGLLFAFGQLRDLFRHLLGCFRPNKDDDVKQGYAPICVGLEDFFVRRLYLRVQDCFGRPIASAPDSWFDVVERTSDDNNKTLQRTSKTTRCLNLTSYNYLGFAAADEYCVPRVVDSLKKYSASTCSARV

SEQ ID NO: 39885 - DNA, 701 bp, Zea mays
  misc_feature: Ceres CLONE 1430834-F
  misc_feature: Encodes the peptide sequence at SEQ ID NO. 39886
  misc_feature (317)..(317): n is a, c, t, g, unknown, or other
aagctggagctccccgcggtggcggccgctctataactagtggatcccccgggctgcaggaattcgcacgagaccattacctagaacatcctaatcaaaaatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctggacgcgccgtgtgccgacccgtacgccgcagagatgcctgcgcanctactcgacgcgctgggagagtacttcttctccaccccgcgcgaagggcggcgacttcccccacgaaggggaacgacaaattcatgatgcacaagttcaagggtccgcgggtgcccccccccccgaaccaccaaatgggcgtggggcccctccccccaccgggggaagccccccgcgtaaggaacccccccccccggcccaaaggggggaaacctgcccgaaatttccggccccccccgggctggggcccccggggccaaaagggcccccctcccaataagcccccgaaaatttgaaggaggggagcaccatttccggaaaccagggccacatataacaaaaaacccctgagggcccccccccgttttttttttgtaaaaaaaa

SEQ ID NO: 39886 - protein, 59 aa, Zea mays
  misc_feature: Ceres CLONE 1430834-F
  misc_feature (31)..(31): Xaa is any aa, unknown, or other
MVSRENLHLVLDPASLDAPCADPYAAEMPAXLLDALGEYFFSTPREGRRLPPRRGTTNS

SEQ ID NO: 39887 - DNA, 725 bp, Zea mays
  misc_feature: Ceres CLONE 1430835-F
  misc_feature: Encodes the peptide sequence at SEQ ID NO. 39888
aaagctggagctccccgcggtggcggccgctctagaactagtggatcccccgggctgcaggaattcgcacgagaccattacctagaacatcctaatcgaaaagtcgctcccatgcctcagcagtgacgggcatggccaaaacagcgtcgcgcactgtgtaggataacattgtctgggtgcttcctgcctaggtgacttttgtcgcaacttggaggagaccactcaccagtttgcctttccgattggaatttcctgtccttgtccatgttctcgcagaggagatgggctggtttatgagaacatttgaggatgggaacacagctagcagcataggatccatgacataacagccctgttaattattgtgcagcagcggagaagatcgagaagactgtcgcacgcgtttgctatagggagtagactgtcgagaagactgtcgcacgcgttttcgaataacccttagagtgttgatcaagccgacggtctccatagaagcaacctgcaaggttgtcagcattgcaaccactgctcaggagaagatgaagctgtggaaggagacttccaggagttccaagactacgacgagttctaggtgtgggttagcggcaacccccagtcggctgcctgtgagggctgcgtttatctacgtttcgtgttcgcactttgatttattgtaaggactatatggacgtctcagacgtatgatgtaatcgactattatttcc

SEQ ID NO: 39888 - protein, 45 aa, Zea mays
  misc_feature: Ceres CLONE 1430835-F
MKLWKETSRSSKTTTSSRCGLAATPSRLPVRAAFIYVSCSHFDLL

SEQ ID NO: 39889 - DNA, 658 bp, Zea mays
  misc_feature: Ceres CLONE 1430847-F
  misc_feature: Encodes the peptide sequence at SEQ ID NO. 39890
cgctctattctagaggatcccccgggctgcaggaattcccacgagaccattacctagaacatcctaatcgaaaactctcacttcgcgggcacgcagagagccgcaagacgcacctcgctcgcaacttgttggactcgaaggggcaataggcagcaggcagggccccgaactgcgggaggagattcccaaggatcccgtcggcctggtagaggaagggacggggactggcgatggcggtggacggcggcggcggggtggactgggagagcctggcggaggccacctccggggcaatcggctcgctcgtcagcaccaccgtgctctacccgctcgacacctgcaagaccaagttccaggccgagctccagacgcaccagggcgcgcagaagtatacgaacctttcagatgtcttttgggaagcgatttgtaaaaagcaatttttgtccctatatcagggcctgaacacgaagaacattcagtcttttgtctcctcgtttttttatttttatgggtatagctattttaaaagactctccttggagaagagtggagcatagtctattggaacaacagccaacttgttagttgcagctgctgctggtgcttgcactgttatcgtgacacgcccattaaatacagcagcttctaagatgcacac

SEQ ID NO: 39890 - protein, 108 aa, Zea mays
  misc_feature: Ceres CLONE 1430847-F
  misc_feature (12)..(106): Pfam Name: Mito_carr Pfam Description: Mitochondrial carrier protein
MAVDGGGGVDWESLAEATSGAIGSLVSTTVLYPLDTCKTKFQAELQTHQGAQKYTNLSDVFWEAICKKQFLSLYQGLNTKNIQSFVSSFFYFYGYSYFKRLSLEKSGA

SEQ ID NO: 39891 - DNA, 554 bp, Zea mays
  misc_feature: Ceres CLONE 1430861-F
  misc_feature: Encodes the peptide sequence at SEQ ID NO. 39892
  misc_feature (338)..(338): n is a, c, t, g, unknown, or other
acccgcggtggcggccgctctagaactagtggatcccccgggctgcaggaattcgcacgagaccattacctagaacatcctaatcgaaaacatgatgtttttggtcatatccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccanctaaaccagcttgaaggcagccaaaaggagctcaatgttgctctgagcaaataatctccaaacttccttgaaaaaatcttttccaatcccagaatatattcctaaagggcataccaaaaaatggggggaattttttgaagggccccattcccggtaaaaccaaattgtccctaagccgaaaacccttttttcccaacccccccccaaagggggcca

SEQ ID NO: 39892 - protein, 75 aa, Zea mays
  misc_feature: Ceres CLONE 1430861-F
  misc_feature (72)..(72): Xaa is any aa, unknown, or other
MEIDSLREGFDRVAEKRSLSSAKALEVVDQIVNEIEQAIVKLQMMNTDSTGNVDHPSILAELKAKLNEMAPXKPA

SEQ ID NO: 39893 - DNA, 674 bp, Zea mays
  misc_feature: Ceres CLONE 1430868-F
  misc_feature: Encodes the peptide sequence at SEQ ID NO. 39894
aagctggagctccccgcggtggcggccgctctagaactagtggatcccccgggctgcaggaattcgcacgagaccattacctagaacatcctaatcgaaaaataagtagctccactctctctcctccaagcttactacatccgttgccgccgccaccatcacctgcacgaactcgtcgtttccgcaaacaccatgggtcgcgtcggcaccaacaccgagaaaaacacctccaggcaagtgaatcgaaaactactactcctgcatgaccctcgacttccacaccaacaagaaggtgctcgaggatgtctcgaatctaccatctaaacgcctccataataaagaggatggcttcactacccaactgatgacacatatccagagtggcccagtccacggcatctcactcatgctacatgatgacgacctccagcgacgaatggactttctggaagataattctccacttcatgtccaacagatccacgttgacgatgagaccatgcagatgctagttgctcttcgcatggccgatctgcctggcgtagaacgccacgatgatgtctctaacactcccgcctaagaactaccacagtacggtgctctccgtcgagacagcctttagacttcacgatgattacctcttgatcgcactgctattcgtagtcgtcgactaa

SEQ ID NO: 39894 - protein, 105 aa, Zea mays
  misc_feature: Ceres CLONE 1430868-F
  misc_feature (1)..(99): Pfam Name: Ribosomal_S17e Pfam Description: Ribosomal S17
MTLDFHTNKKVLEDVSNLPSKRLHNKEDGFTTQLMTHIQSGPVHGISLMLHDDDLQRRMDFLEDNSPLHVQQIHVDDETMQMLVALRMADLPGVERHDDVSNTPA

SEQ ID NO: 39895 - DNA, 653 bp, Zea mays
  misc_feature: Ceres CLONE 1430901-F
  misc_feature: Encodes the peptide sequence at SEQ ID NO. 39896
gcggtggcggccgctctttaactagtggatcccccgggctgcaggaattcgcacgagaccattacctagaacatcctaatcgaaaagcaaatcgggagaaggggtttttatagcctcctcgcccgctccgaatcaggtcgaggtagcagctccccccgcaaaaaccctagctttacctccccacaagcgcctccaagatgaagctcgtcaggttcttgatgaagctgaacaacgaagcggtgaccatcgagcttaacaacggcaccgtcgtacacggaaccattaccggcgttgacatcagcatgaatactcatctgaagactgtgaagctgacactaaaagggaaaaatcctgttacccttgatcaccttagagtgaggggaaacaacatccgctattatatccttcctgacagcctaaacctggagactttgctggttgaggaaacaccaagggtcaagcctaagaagcctacttctgggaagcccttgggacgtgggcgtggccgtggtcgtgcgcccggtcggcgtgggggacgatgaacatgctaaatgcttttggaaatgccttgccggcttctgcagggtaacctatttccaaacaattgtccggagtaggcctttgattatgccaccatgcaaccactgtttttt

SEQ ID NO: 39896 - protein, 114 aa, Zea mays
  misc_feature: Ceres CLONE 1430901-F
  misc_feature (5)..(70): Pfam Name: LSM Pfam Description: LSM domain
MKLVRFLMKLNNEAVTIELNNGTVVHGTITGVDISMNTHLKTVKLTLKGKNPVTLDHLRVRGNNIRYYILPDSLNLETLLVEETPRVKPKKPTSGKPLGRGRGRGRAPGRRGGR

SEQ ID NO: 39897 - DNA, 660 bp, Zea mays
  misc_feature: Ceres CLONE 1430907-F
  misc_feature: Encodes the peptide sequence at SEQ ID NO. 39898
ggagctccccgcggtggcggccgctctataactagtggatcccccgggctgcaggaattcgcacgagaccattacctagaacatcctaatcgaaaaggcgggaccatggcgccgtcctcctcccgattcgacgatccggcggcggtgaggcgccccccgcagcatgaacggaagccgccgtatatgttgcttctcccgctcgtctacgcccccgtcctccccctcatcaggatcgggctgcggcacaatcccgtagtgagggaccgtctcttctacggcgtcctcgccggcgcattcgcccacggcgcctacctcatatcggaactgtatgatgtggagagcaaatgatgggcatccctcgaaggatgaggggataagttttcaggtagcaaaatttgattccatcgggattccagattgttggatgagagctgacatggcaattcagactaactagtgtgctatgtacccatatgttttctttggtcttgctattatgtttggcaaaaggatggaatggttgagcaaataaagtaattccagattgagaaattccgcggccacgtaaaaggcggcatattacggatgcgaaacgaaccttataaaaaaagaaaaaagctatcgataccgtctacctcaagggggggcccggtacccatt

SEQ ID NO: 39898 - protein, 80 aa, Zea mays; identical to SEQ ID NO: 9524
  misc_feature: Ceres CLONE 1430907-F

SEQ ID NO: 39899 - DNA, 648 bp, Zea mays
  misc_feature: Ceres CLONE 1430911-F
  misc_feature (78)..(78): n is a, c, t, g, unknown, or other
  misc_feature (83)..(83): n is a, c, t, g, unknown, or other
  misc_feature (84)..(84): n is a, c, t, g, unknown, or other
  misc_feature (104)..(104): n is a, c, t, g, unknown, or other
  misc_feature (565)..(565): n is a, c, t, g, unknown, or other
ggagctccccgcggtggcggccgctctagaactagtggatcccccgggctgcaggaattcgcacgagaccattacctnagaanncatcctaatcgaaaaacccnacacatccgacgccgaggaagtaggaagcacgaccagcatatgtcacagagggccagcgtcccacactcctcctgcatagccttcgcgctccattcccattctcctggtctccagtgagaaagtgcccccagctcctataggcaagcatagctattctccgccctcctttttttcctcctcttctccccttcccccggcgggatttctttcccttgatcgagctgggtctcaccttccgttttttaggtttggtggggatctttgtttctcggaacccgctcctcccaaaccccccgaaagcccaaaagggaaaaaaaaaaaacccgggaaaaccaaggaaaatggggggtccaagggtaatttccccccaagaggggggggtatttcacccccccctttgggggggggggggggtttttcccccccccccccccccccgtgggtgggacctccctcactnaagggggcctccccccccctccttcctttcttttttattggagaagatgaagagttgtgcttccccccccccccccctccttt

SEQ ID NO: 39900 - DNA, 669 bp, Zea mays
  misc_feature: Ceres CLONE 1430924-F
  misc_feature: Encodes the peptide sequence at SEQ ID NO. 39901
  misc_feature (473)..(473): n is a, c, t, g, unknown, or other
  misc_feature (565)..(565): n is a, c, t, g, unknown, or other
  misc_feature (638)..(638): n is a, c, t, g, unknown, or other
  misc_feature (639)..(639): n is a, c, t, g, unknown, or other
ggagctccccgcggtggcggccgctctagaactagtggatcccccgggctgcaggaattcgcacgagaccattacctagaacatcctaatcgaaaaatgtccttgtcgcattcctgagagttgctaccaccggcgctaggggggaagaggccgccggaagatccgccatgagcagcgatcagcagaacgatgctcctggaagctacttcgtaggccgtccaaccaacccgggcgacaagacggaagaaccgcacgcccgcggggaccagaacccggcgaccgcgcaaactcccggcgagtacttcgttgggcgtccggcgagccatccccagaaggaacaggaagcagcacagcagcaaaccactaggcagagcacaccaagcttcttggccaaatgctgtccctgcctcgccggaggtggagctgcggaatagatcaagaactgcctcctgcagccctggctagggcacccnacgaattgtgcgcatgagaatttggagtaatctgggatggtgatctatctatctgtatctgccctcgcaccttgtgctctggaaaccccccnctttttttttttcttttttcctcggtgtcccctttttaaatcgttcctctgcatccatacaactgccccgtanntgcaattgggtccaaccagcttgattttgt

SEQ ID NO: 39901 - protein, 88 aa, Zea mays
  misc_feature: Ceres CLONE 1430924-F
MSSDQQNDAPGSYFVGRPTNPGDKTEEPHARGDQNPATAQTPGEYFVGRPASHPQKEQEAAQQQTTRQSTPSFLAKCCPCLAGGGAAE

SEQ ID NO: 39902 - DNA, 645 bp, Zea mays
  misc_feature: Ceres CLONE 1430946-F
  misc_feature: Encodes the peptide sequence at SEQ ID NO. 39903
  misc_feature (622)..(622): n is a, c, t, g, unknown, or other
ccccgcggtggcggccgctctataactagtggatcccccgggctgcaggaattcgcacgagaccattacctagaacatcctaatcgaaaatccaaaccccgacccttttcatccctccctccctccctcgtcgtctcctgactttgctcgccggccgccccgcccacaccctcctcctgcgctaccactgtcagcaagtgcacacccttcgaggacagctgctgtcgccgccaaggccgcaaccggccgtcgctccatgctgcggtagaatttaaaaacgagaagggagatggcggccgaggcgctggggttcatggcgcggggagccaacggtgggagggcggcggagctcgtcacaagggactttctcggcgggtgcgccgcccccgacgacgccagggacgcgtccgccaggaatggcaccgtgcccgggagggtggctcaacagaagcacgcgtgcccggcaacgccgatggacctcaacctgttcccgatcgcggccgcgacgaagccctgcgccgtgacaacggcgccgtcgccagagccagcgccagcctccgcgggcggcgccggcgccacgacgacgtaccgcagcgtgtgcactttcaagaaggtgaagacngcccttgaagcggttcgagcccg

SEQ ID NO: 39903 - protein, 118 aa, Zea mays
  misc_feature: Ceres CLONE 1430946-F
MAAEALGFMARGANGGRAAELVTRDFLGGCAAPDDARDASARNGTVPGRVAQQKHACPATPMDLNLFPIAAATKPCAVTTAPSPEPAPASAGGAGATTTYRSVCTFKKVKTALEAVRA

SEQ ID NO: 39904 - DNA, 836 bp, Zea mays
  misc_feature: Ceres CLONE 1430946-R
ttgggtaccgggccccccctcgaggtcgacggtatcgataagcttttttttttttttttttcgcctcgatcaattgtggtagtaggattgattggttctacaggagcagcagcagtatcaaccatcattcatgttctatgctacgccatggcaaacaaccgggaggggagtctgatcggtcataaatttcctgacaaccggaaggggagggcatgcatttctctgctggagcctctccaactcggttcgtggatggatcgtcacattacacgagcctataatttaggacgtacgtacgtacgtacggtacgagacgagacagcggccgatccgtctaggctacgccatggcaaagaagaaattaggtgccgaggtagccgacgttgaggtcgagccgcggcttcttgctcacggccggcgccggcggggccgggacgtgggactcgcaccgtgggcaccgcgggtcactccgggagatgagcacgtacaggaagcacctggggcacgccccggcgaccatcccgccgccggagggcgagtcgcattcgtcgccctggttcaggccgccgccgggccgctttagggaaggactgggtcccgtccgacaaccaacgggaaggcgcccgcgccccctgtgctgcttgctgctgctgctcctgggggtggtttttggtcccaaatagaaaagggtcttgtttcttcctttccccgcctttaaaaccgctccaaaggggccttcttttccccttttctaaaaggggccccacccccccggcgggcaccttcccccttgtggggcgcgggggcccccccccccctaagaaagagtggtggcc

SEQ ID NO: 39905 - DNA, 664 bp, Zea mays
  misc_feature: Ceres CLONE 1430991-F
  misc_feature: Encodes the peptide sequence at SEQ ID NO. 39906
  misc_feature (539)..(539): n is a, c, t, g, unknown, or other
tccccgcggtggcggccgctctagaactagtggatcccccgggctgcaggaattcgcacgagaccattacctagaacatcctaatcgaaaaaccattaaatctttggctattaggacgcttctctcctcccaaaccccacatctcagcaagggccccgtcggctagcgccgcatccgcagaccgcagccgtcgacgcagaccctcttcggcagccgcttgcagcgcgtcccttccccgctcccggcgccatggactgcgcaaaggggagggcggtggcggacctctacgacgaggtgatggtggagatcctctcgcgcgtgcccgtcaaagacctccgccgttgcacgtgcgtgtgcaaaatctggcgcaacctcatcacggaccccttcaccggcaagaagctgccccagaccctgggaggcttcttccccggcgtcgtcggaaggccctcccactaccggccaatttcccccaaccttggcggggaacgggaaaaaaccggggggttccgggagaaacccttttctttccccttttnaaaacaaaaaattgtttccctgggggggaaacccagggggccccctttggaatttttgtaaaagggctctcctgttttttggggggccccccggggagaaaaaaattccgggctttcctctggaa

SEQ ID NO: 39906 - protein, 116 aa, Zea mays
  misc_feature: Ceres CLONE 1430991-F
  misc_feature (7)..(54): Pfam Name: F-box Pfam Description: F-box domain
  misc_feature (97)..(97): Xaa is any aa, unknown, or other
MDCAKGRAVADLYDEVMVEILSRVPVKDLRRCTCVCKIWRNLITDPFTGKKLPQTLGGFFPGVVGRPSHYRPISPNLGGEREKTGGFREKPFSFPFXKQKIVSLGGKPRGPPLEFL

SEQ ID NO: 39907 - DNA, 689 bp, Zea mays
  misc_feature: Ceres CLONE 1431008-F
tggagctccccgcggtggcggccgctctagaactagtggatcccccgggctgcaggaattcgcacgagaccattacctagaacatcctaatcgaaaatttattcctccctcacttccggccttccccttttcctccggtcgacgcgagggagcgggaggttggcctctaggcagggtggcgggcgaagatgttggacatacagaagcggcgcgtgcggctgctgctcttcatcacggccgtcctcgcgctcagcatcacccgctgaaaaagtccagggaacttgttggaaaggagggtggctccaaaaaggggggccatttcaccattcatgaacctggcttgaacatgggttctggcaacctttgccgtgccctgcaaagggaggggggtcaggtttgtacctcccccacctttcccaaaggggcaccctttgaaagtgggggggcccacccacccgggggaaaaagtgtttttctggagggcggtggcggaagggcctcacccctcttgggacgccccccacaacgctctaaaaaaaattttgggcaaaaaaacataatttttgtggtgtcctcctaacccaaaagggatttggggcgccaaaaatttttttgtggggggggggactcctcccccaaaaaaatttttttttgggggaaaaacaacaagaaaatttttttccccgggg

SEQ ID NO: 39908 - DNA, 648 bp, Zea mays
  misc_feature: Ceres CLONE 1431040-F
  misc_feature: Encodes the peptide sequence at SEQ ID NO. 39909
tggcggccgctctagaactagtggatcccccgggctgcaggaattcgcacgagaccattacctagaacatcctaatcgaaaaatagatctcacactccatgctagccaacaccagctactgctcggtgaactagtttggtacgtaccagctagcacgatggggcagcttagcaagaaccttctggtggcgtccatggtggcggccgtgctggccgtggcggctgtggagctgtgcggcgccatcccgctggaggacaaggacctggagtcggaggaggcgctgtgggacctgtacgagcggtggcagaccgcgcaccgcgtgccccgccaccacgccgagaagcaccgccgcttcagcaccttcaagtccaacgcccacttcgtccactcccacaacaagcgcggcgaccgcccctaccgcctcctcctcatccgcttcggcgacatgagccatgccgagttccgcgccaccttcgtcggcgacttccgccgcgacaccctgtccacgccgccgtccgtccccggattcatgtacgccgccgtgaacgtgtccgacctgccgccgtccgtggactgtcttcagattggcgccgtgacgggcgtcaaggacccacgcaagtgcggtagctgctgggccttctccacggt

SEQ ID NO: 39909 - protein, 163 aa, Zea mays
  misc_feature: Ceres CLONE 1431040-F
  misc_feature (46)..(102): Pfam Name: Inhibitor_I29 Pfam Description: Cathepsin propeptide inhibitor domain (I29)
  misc_feature (37)..(163): SWISSPROT Homolog: EC 3.4.22.31 Ananain
  misc_feature (133)..(163): SWISSPROT Homolog: EC 3.4.22.67
MGQLSKNLLVASMVAAVLAVAAVELCGAIPLEDKDLESEEALWDLYERWQTAHRVPRHHAEKHRRFSTFKSNAHFVHSHNKRGDRPYRLLLIRFGDMSHAEFRATFVGDFRRDTLSTPPSVPGFMYAAVNVSDLPPSVDCLQIGAVTGVKDPRKCGSCWAFST

SEQ ID NO: 39910 - DNA, 655 bp, Zea mays
  misc_feature: Ceres CLONE 1431042-F
  misc_feature: Encodes the peptide sequence at SEQ ID NO. 39911
  misc_feature (463)..(463): n is a, c, t, g, unknown, or other
ggagctccccgcggtggcggccgctctagaatagtggatcccccgggctgcaggaattcgcacgagaccattacctagaacatcctaatcgaaaaaagtgtttggttcgtgactaactttaggcagccacaaaaagtgtggcgaggttccctgagcttgccatactttttttcgccgcatctggggcgctcgttttcgatgccccagcaccgctacgcgccgcacttcgcccccttctctccctctcatgccgctggttgatctctcgtcatctcctcctccaagcacggatcttctcgtcgtctcctccaagcacggatcaggagcactgaaattctatctcaaccggttctgccgactgggtaacttgaattctaaaggttgatccaagcaggagatgaatgtgtgatggttggttattttgcatttcttctaggttgatgcatgacggttcatggagaangctggtggttgtgatagctatcacacactcttttggttaataattagatactctttttgttgagcaatgtgaacctttaatgatgtttatgggtcttgtggagttgtgatggggctattatgaagatgctatggcctgttatggatgattggacatgttatgggctctatatattaatctgttagtttgggt

SEQ ID NO: 39911 - protein, 45 aa, Zea mays
  misc_feature: Ceres CLONE 1431042-F
MPLVDLSSSPPPSTDLLVVSSKHGSGALKFYLNRFCRLGNLNSKG

SEQ ID NO: 39912 - DNA, 642 bp, Zea mays
  misc_feature: Ceres CLONE 1431045-F
  misc_feature (278)..(278): n is a, c, t, g, unknown, or other
  misc_feature (536)..(536): n is a, c, t, g, unknown, or other
tccccgcggtggcggccgctctataactagtggatcccccgggctgcaggaattcgcacgagaccattacctagaacatcctaatcgaaaaactttgtttgcaaagctcctcctcgatccatcgatcactgcaccggccggcggcaccgcgctcgcaggggctagccaacgagacggcagcaatggcggaccgtgacgcagcggctctacggcggcgccacgccactacgggcagcagcagcagcagggaagaagcgggcgccctgatgggtgaccangtgaaaggcatgctccacgaaaaggggcccaaacggcttcccaggcgccaaacgggggggaaccctttttcccccctgggccgccctccctcctggtttttttcggggcttgcccataaaccccccccccgggggggggctgcgcccggggccccccccccggtgttttataaatttttaccccccgggtgtttccccccccccccctgttttttttttataaaaagcccccctatgggggtccccccccccgggggngccccctggggggttggggggttttggcccccccccaaggggcgccccccaaaaaaaggggggggggggggtcccccccccccccccccccataaatggggggggc

SEQ ID NO: 39913 - DNA, 669 bp, Zea mays
  misc_feature: Ceres CLONE 1431050-F
  misc_feature (340)..(340): n is a, c, t, g, unknown, or other
  misc_feature (342)..(342): n is a, c, t, g, unknown, or other
  misc_feature (355)..(355): n is a, c, t, g, unknown, or other
cgcggtggcggccgctctatcctagtggatcccccgggctgcaggatttcccagaagaccattacctagagcatcctaatcgaaaagagacctccactagtacccaggtcgacgatttcttcccccctctacgatctcgacgcgcacctatgcggacgatgtcgtccgcggttaatggtatgctgcgggaaggggtgcgcggggcagcacgcgttcgcggcggcggcggctagggggccaggcggtggacgaccccaggtcacgaggagcgccccaaggggtacctcttcaaccggtcgccccctcctccgggggaatctcgcaagtgggaggattgaananatgcttttataantgacctccttccgcggggcgtcatcctcagggtgggtctcaagggggccccccccccttacaatcaagacatgggcgcaacagatagtctctcgagcgcctccagcagcaggagatcgccgctgccctaaacccaagcttgactgatccccacgtcttcaggaggtatcgaactcgtcggatgcctctgatttggttgcagtaaaagggccgcattgaagcggccccgagtggttcgggacttctggtttttggttggacacgaacctgaagcacgggccgggtgcttgttcccgttcgtgttcttgaagttgg

SEQ ID NO: 39914 - DNA, 710 bp, Zea mays
  misc_feature: Ceres CLONE 1431060-F
  misc_feature: Translation starting site: 232
  misc_feature (296)..(296): n is a, c, t, g, unknown, or other
  misc_feature (320)..(320): n is a, c, t, g, unknown, or other
  misc_feature (321)..(321): n is a, c, t, g, unknown, or other
  misc_feature (361)..(361): n is a, c, t, g, unknown, or other
  misc_feature (410)..(410): n is a, c, t, g, unknown, or other
  misc_feature (424)..(424): n is a, c, t, g, unknown, or other
ggagctccccgcggtggcggccgctctagaactagtggatcccccgggctgcaggaattcgcacgagaccattacctagaacatcctaatcgaaaaatcatcgctcgctcttctcttggtcttgcaactccagtgctgctcactgccactgccagcagatcgagctgctccgcctcactagccctcttgctttgctgctgcacctgcaagtctgcaaccgcgcacagagagatgtcgacggtgagccgtgcgtccctcgaccagaagctcgccctcgccaagcgctgctcccgagnagcgaccctcgccggagccaagcnngcagcgtggcgactatcgcctccgcgatccccaccctggncagcctgcggatgctgccatgggccaaaggcaaaatcaaccccaccggncaagggcttatcgncccccccgggggttggaaggcaaaacttcatcccccccaaaaaaaaaatctggccctgtggaagccccctctttttaaaaaaccccctgaaaacctaaaaaaccccctcttccggggaccggggccccccacccggtttttttttgggggggaaaaaggccccccccaaaaaaaaaccccaccccttgttgggggggggggggggggaaacccccccccgcgcgagaaaaattttatttttttcgaggaggggctctgaaaaaaccttttcttttattaattcgag

SEQ ID NO: 39915 - DNA, 730 bp, Zea mays
  misc_feature: Ceres CLONE 1431065-F
  misc_feature (573)..(573): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
acccgcggtggcggccgctctagaactagtggatcccccgggctgcaggaattcgcacgagaccattacctagaacatcctaatcgaaaaaaaagaaatagagatgagctagagggggccggggccgggagagccaagggcccgagggagatggagaaagatgtgaagctatttgcttctgagtggaatgttgtctggttcaaggtcttttgctttgtgatccatctgtgtagagcttcttagtatccttggatctgcagatctcggaccaggtttcttcccctccaaaatacctccaaaatgaattccgggaagtttgggaaagcttcccccccggggagaattttggcccaagtttttttttaaaagatttggtgaggggtcccaaaatcccccggcccgctttataaaaattgggggggggggaaacccccagtctccccccccggggttttataaaccacccccggggttttttttttttttttttttggccgcgccgcgggcccccaaaaaaaaaaaccccccaatggggggggtgggggggggttttttcccccccccttcttttgntctctctnnngggggggggggggnnngggggaaaaacccccccccccccctggggggggggagacgcccccctctcccccccccccccctctgggggttttttttttccccccccccccccctcttttttttatgaaaaaaaattgttgggggccga

SEQ ID NO: 39916 - DNA, 914 bp, Zea mays
  misc_feature: Ceres CLONE 1431170-F
atttccccccctccccgctcattgttttcccagcaacgctccctcctcctattctggggctccctgcggtggcggaccgctctttaatagcggatcccccgggctgtaggttttcgcacgagacctttacctagaacatcctaatcgaaaagaccgatctgtccgatctctctcccgagtccactccaagccttttcgccttttcctccgccttctcgcgagggcgccgccgcgccgcgctctattcgtcctcgccgctctcctcctctccctctttcttggggccgcctccttccattccgaccagtttctttttaacgaagattaagagctctagggcgttctcggatgtcccgcctgcccctcccagaaagacggccgccgcgggcctactccctcccctgacgccggatctattcgagatgctgggcgccccggtgccagtttgaattatccctgaatttggcgcccaggaaggccccccggccccttggcctaacccccgcacctcgatgggcgcttcgttttctcccccatgttaaagagttaatctgcgcggcgagtcgcctgtggtcccccttccacccacgcctcagggcggtgcgttctcttgcgttatgcccgctgccttctaaatattttcggtgccacttccaacggggttagcggtgcagcacccggagaaaccaatcacgaggcttctacacttcgattctggctatgccatagtaacgtcgccctggttatccaatccctttgcccgcgacttgtattatatacgtctcgcgctctttttctatctatcaccgcacaatccacgggcgttgtattctatacgcgtttaccccccctctagacctgtgtcccacccgaattcttatctcctatttctcggcctccaattaataatttag

SEQ ID NO: 39917 - DNA, 720 bp, Zea mays
  misc_feature: Ceres CLONE 1431179-F
  misc_feature: Encodes the peptide sequence at SEQ ID NO. 39918
tccccgcggtggcggccgctctataactagtggatcccccgggctgcaggaattcgcacgagaccattacctagaacatcctaatcgaaaaattatctcatggttcattatcctttggaagctcttagacagatccagtctgctgatataaaaatgaagctactagagatgcagaagggagaattgaggtgcctcctacccagaagtttgcttgataatggattttttggtatccgttctagtgaagataaggatagcaagaaaaatactggtccgttttcaagttttagttggagtggtcaacgcaaagttccatcatatcttccaaaaattgttttccctcatgaatttatgagtactctacgtactattgccatgcaagaacatgagcttgaacaggttgcttctttacttggagaggttggatatagtgaagacagagaaacatcttgtgcagcgatccaaagtgctatttgggaggtctgcggtgatcagggtgcactggttttgcttgtggatcttctcggggtcaaaatggctgaacttgaagagggctctggaacagaagcatctgacgccgaactgctcgagcagttcgattccattcagccagaagactacgcgagtgaaagcggcgagaagcacgaaaggaagtcaaagacaaactaccgttcgtgtgtagtgtaccggagaggggcaaagcagctgacgaggctgttc

SEQ ID NO: 39918 - protein, 207 aa, Zea mays
  misc_feature: Ceres CLONE 1431179-F
MVHYPLEALRQIQSADIKMKLLEMQKGELRCLLPRSLLDNGFFGIRSSEDKDSKKNTGPFSSFSWSGQRKVPSYLPKIVFPHEFMSTLRTIAMQEHELEQVASLLGEVGYSEDRETSCAAIQSAIWEVCGDQGALVLLVDLLGVKMAELEEGSGTEASDAELLEQFDSIQPEDYASESGEKHERKSKTNYRSCVVYRRGAKQLTRLF

SEQ ID NO: 39919 - DNA, 850 bp, Zea mays
  misc_feature: Ceres CLONE 1431180-F
  misc_feature: Translation starting site: 246
  misc_feature: SWISSPROT Homolog: EC 1.1.1.14 L-iditol 2-dehydrogenase
ggtttccgccctctttatcctcattctctttcctcctcccttttcttccttaatatcgggactcctcgtggtggcggccgctcttcactagtggatcccccgggctgcagttttcgcacgagaccattacctagaacatcctaatcgaaaattcttcgccaccccgccggtgcacggctcgctggcaaaccaggtggtgcacccggacgacctgtgcttcaagctccccgacggggtgagcctggatgagggcgccatgtgcgagccgctgcagcgtgggcgtgcacgcgtgccgccgcgcgggggtggggtccgagacgggcccgctcgtggcgggtgtttgtccccatcggcttgaggccgctgctggcaggctaccgcctttcggtgcctcgcgcgtggtggtcctggatgtggactaatagcgcccagggacccggactaggtcgctggggaggggacgcggacggcccccgttgttttcccccttccggaatggatttggctagcattattttcgattttgtatcccgaacggtcgcctgtgttcttattaacccgtgccccgttcctatttgtgaattggggacactcgcgatccacgcaaattactcattttcagaactggcggctaagaagaacgcgttggaccgcgcgtcgcataaagtgccgcgcactggttctggttaccgaccccaccccccttttccgacacgtgtacccgcttatatttacttgccggccccgctggttatacctgcccccatgtccccccccatgttcttcccccattaacccacatgtttgctgccaccggaactgaactccttatgccgcacgatttattgtt

SEQ ID NO: 39920 - DNA, 717 bp, Zea mays
  misc_feature: Ceres CLONE 1431181-F
  misc_feature: Encodes the peptide sequence at SEQ ID NO. 39921
  misc_feature (458)..(458): n is a, c, t, g, unknown, or other
tccccgcggtggcggccgctctagaactagtggatcccccgggctgcaggaattcgcacgagaccattacctagaacatcctaatcgaaaaaacaaagttcagttgagttcaatgctcagccatgaagagaaatgagatcgcagcagcagccatggttttgctcttgttgacgttgggcgctgaggcccagatctgttactcgcggagcaagaccttcaaggggtggtgctaccacagcaccaactgcatctccgtttgcatcaccgagggggagattagcgggttctgccagcatggaatttgcatgtgcacctatgagtgtctcacgggtaacgaagctagcctgcctggtggtggtggtggtggtgaagacccacagttattacacgtcgccacgccaaacggtgatggggctagaccactgtcacttgaggatgacaaggaagagacatcgacngagacggctatgaggggcgcaaagagcatagtccgcgctacatgaggaagtagctgacagtagagcggctggtttcggggggagggtgctacctctcttccacatgctaatttgagttgaagaataaaaaatttggtttgggtttaaaaaaaaaaaaaaaaaaaagctttaatcgaaacccgccccaaccccgaagggggggggcccggggaccccaatttccccctcaaaagggagaggccttattaacccccccccc

SEQ ID NO: 39921 - protein, 126 aa, Zea mays
  misc_feature: Ceres CLONE 1431181-F
  misc_feature (23)..(67): Pfam Name: Gamma-thionin Pfam Description: Gamma-thionin family
MKRNEIAAAAMVLLLLTLGAEAQICYSRSKTFKGWCYHSTNCISVCITEGEISGFCQHGICMCTYECLTGNEASLPGGGGGGEDPQLLHVATPNGDGARPLSLEDDKEETSTETAMRGAKSIVRAT

SEQ ID NO: 39922 - DNA, 705 bp, Zea mays
  misc_feature: Ceres CLONE 1431184-F
  misc_feature: Encodes the peptide sequence at SEQ ID NO. 39923
gctctataactagtggatcccccgggctgcaggaattcgcacgagaccattacctagaacatcctaatcgaaaaattttattaaactttcgcaagcgcaggtatctccccacagggcagcgcgtgcggaaaccctagtcgccgccgatgtcggaccctttctacccgtactaccgcggagccttcccgggcggcgacggtgcgcagccgccgccacgttactcggattttgaggtcgacctcatcgcggcccgttacgccggcaccctattgccttatccatcctctgccgacgtcggcgccttcgactcgtatgtcggcgcgagacgatccgcggaagttctctatcaccaatcttttatgggaagtcatagtactgttgggccagaatgagggtttatattcatcgaatactatgcctaaaccccctagggcttgaaagcagcctttgttatatatcccccaacaaccgggggaaaaaggactggtgccttcttttttaaccactggaaacctgtaagtttgggaaaaaacctgcaaattttgaccctccccacaggggtttcccaaagggggggggttcccaatttgggaaaaaggccccccaatggttaaaaaatttcttttctctgggggccccggggggaacaccaattggcctcttttttttttaaaaaagagagaggcaaattttaaaatttcaagg

SEQ ID NO: 39923 - protein, 81 aa, Zea mays
  misc_feature: Ceres CLONE 1431184-F
MSDPFYPYYRGAFPGGDGAQPPPRYSDFEVDLIAARYAGTLLPYPSSADVGAFDSYVGARRSAEVLYHQSFMGSHSTVGPE

SEQ ID NO: 39924 - DNA, 995 bp, Zea mays
  misc_feature: Ceres CLONE 1431185
  misc_feature: Encodes the peptide sequence at SEQ ID NO. 39925
aatcgcgagaaccgcagccagctacccaccaccctgcagctccgagcttttaccccgctttgactccactctaccgctcctccagcctctgttgtttttgtttcccaccgcaagaatccggccgcctacctccgctcctcccgacgcctctctgctagtatagtgctaccgctaactagagctccatccacacgtcaccgccgtacccacgcgccccggcttgttcgttaagcttgccggccggccgcctggcgcgcaccgccgctacgcgcgctgggcctggcggcgcgtgcccgcagctagcatgagaaggcggtggtcccgcgccgcggtgctcgcgtgcttactgctcctcgcgtgcgtcgccgagtcgcgcgcggtgcccgacgcctcggggggcggcggcggcccaggagagcagcggcggggcgcgttcgacgtcgtggtcgtcggcctcgtcagcatcggcctcggccgccggtggcgcgccggcgccggcgccggcgagatggtcgacgaggacaagcgccgcgtgcccacggggcccaacccgttgcacaaccgatgagcgccagccaccgcgcggcctgccctagctaggcggcctagctacctgccttatcgatcgagcggcggcggtcatttgctctactgcccaggcgccgcgcccgctgttgccgggaggacgcgtgcatgatcgacgacgtgccgagcgaggtggagaagaatgagaaggagaagagaggagcctacgtgtcagtatttctactaccactactcctactactactccctccctgcttccctttcttctctttctcctcgctagtaagaatttttcttcttctcttccatcgcctgttctcgtggctgtgtttccccccgcctgtattggcttgccaagcgaacagcaaaggctattctgttgattgatcggaagagaaagatactagtatatgagtatagtgtttcctgtttgaaaaaaaaaaaaaaaa

SEQ ID NO: 39925 - protein, 87 aa, Zea mays
  misc_feature: Ceres CLONE 1431185
MRRRWSRAAVLACLLLLACVAESRAVPDASGGGGGPGEQRRGAFDVVVVGLVSIGLGRRWRAGAGAGEMVDEDKRRVPTGPNPLHNR

SEQ ID NO: 39926 - DNA, 710 bp, Zea mays
  misc_feature: Ceres CLONE 1431189-F
  misc_feature: Translation starting site: 146
tcttaactagtggatcccccgggctgcaggatttcgcacgagaccattacctagaacatcctaatcgaaaaacagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaacgaggtggcggagaagccggaggaggggaagaagcccgacgaggagggtgacgagaggaagaaggccgaccccgcctccgagaaggagaagaaggccgaccccgccgccgagaaggagaagaaggcgaggaagccgcggagcacgaagcccaagtccgccgggctgcaccaccccccctatttcgagatgatcaaggagggcgatcccgtttctcgacggcgggaaggtcggggcgagcccttacgcgaacccccagcacatgggggatgaacaccggcacatgctcccgcccaattaccgcaaggtgcatggccgtgcagctgcgccggattcttccgccaagggccgccttccccaaggccgaggctctcccttccatgctcgccccccccccatggaaaggaatcccctcccgcggccccctaaaggcccaatcaacaagtggtttttgcgtgccaatggcctcagcgctcatagagggcctcttcttcgc

SEQ ID NO: 39927 - DNA, 522 bp, Zea mays
  misc_feature: Ceres CLONE 1431194-F
  misc_feature: Encodes the peptide sequence at SEQ ID NO. 39928
  misc_feature (112)..(112): n is a, c, t, g, unknown, or other
  misc_feature (336)..(336): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
cgcggtggcggccgctctagaactagtggatcccccgggctgcaggaattcgcacgagaccattacctagaacatcctaatcgaaaaccagagtccagtccccagacgagcnggttggagcttcgacgtgcggtttccatttccttccctgctctgatggccgtcgccgaagtggcgatcgagattctcccgcagcagcagcagcagcagccgccgccgtcgcagccgcgggaacccggcgtagcgccccccgaacttcctccggtgcgaagagtgctcagtatctgtacctctgagcgcctggtccccttgcccgggcctgctgcccgaacgtgncccccccggcccttggcgacccttccccgttgggcctagggttcctcaaaatctcaaatcggacccccctttttttcccccggggtgggttattacccccnnntttttttccccccccggggggggttttttggccccccccccttttttttgggggggggggggtcaataaaaaccccccccctc

SEQ ID NO: 39928 - protein, 72 aa, Zea mays
  misc_feature: Ceres CLONE 1431194-F
  misc_feature (60)..(60): Xaa is any aa, unknown, or other
MAVAEVAIEILPQQQQQQPPPSQPREPGVAPPELPPVRRVLSICTSERLVPLPGPAARTXPPRPLATLPRWA

SEQ ID NO: 39929 - DNA, 702 bp, Zea mays
  misc_feature: Ceres CLONE 1431196-F
  misc_feature: Encodes the peptide sequence at SEQ ID NO. 39930
cgcggtggcggccgctctagaactagtggatcccccgggctgcaggaattcgcacgagaccattacctagaacatcctaatcgaaaatactgattactaaaagcagaacaaccacaaaggtgtttcaaaaaaaagaacaaccacaaagacagagaatcaaagaagaagtaacatggtaaaggtgatgtggggttccagtttagctctcgccgtagcgcttctcctggtgacggtggcaaacattccggtggcggagggagtgacatgctcgccgacggaactgacttcatgttcgccggcgtttatgtcagcttcgccgccgtcagcaacgtgctgcgccaagctgagagagcagaagccatgcctttgtggatatctgaggaaccctaccctcagccagtacgttaactctccaaacgccaagaaagttgccagcagttgcaatgttgcaaccccgaaatgttaatcatgattaattagtgacaagtttcgctgatcatgagtgcttaattactagttaaaatgggtctggtcttcgacactactgtttagaataatagtgtggtggtgattatgatgcatcatcatgcttgaatgttatgttatgtcatgttatgctatgcatgttatgctatgcatgttatgttatgtatgtttctatcttatgaaacattttccatagttattaatgcttactactgg

SEQ ID NO: 39930 - protein, 97 aa, Zea mays
  misc_feature: Ceres CLONE 1431196-F
  misc_feature (32)..(97): Pfam Name: Tryp_alpha_amyl Pfam Description: Protease inhibitor/seed storage/LTP family
MVKVMWGSSLALAVALLLVTVANIPVAEGVTCSPTELTSCSPAFMSASPPSATCCAKLREQKPCLCGYLRNPTLSQYVNSPNAKKVASSCNVATPKC

SEQ ID NO: 39931 - DNA, 781 bp, Zea mays
  misc_feature: Ceres CLONE 1431199-F
  misc_feature (612)..(612): n is a, c, t, g, unknown, or other
  misc_feature (613)..(613): n is a, c, t, g, unknown, or other
  misc_feature (748)..(748): n is a, c, t, g, unknown, or other
  misc_feature (749)..(749): n is a, c, t, g, unknown, or other
  misc_feature (751)..(751): n is a, c, t, g, unknown, or other
  misc_feature (752)..(752): n is a, c, t, g, unknown, or other
ctccccgcggtggcggccgctctataactagtggatcccccgggctgcaggaattcgcacgagaccattacctagaacatcctaatcgaaaattctggagacttcctgcggcgcgtggagagtggaggcagggggagaaggaagcagcagcagcagcagcagcagctccatccgctcgcttccttcccccaccgccagcgtcgcctctccgtgtgcgcgccccgtcgggggtggcgtcgctgcacctttgggcagcacgcacctacgtgcggggggagccacacgcctccccctcgcctcttgaaatggacgccggcggagagaagtgccgccacccggcggcagagggcggagacctctacggggttctcgggcgaaaaaaggatgcctctagggctagcttaaaccccctttaccggaatctcgtctataaaaggggacccttggaataatggtccttcctccaacgaccgggaaaacaccatgggggcgatcctatggggcaagctcccaccaatcccagggcccccctactcgccccccctcccaactcgcaagaagcgccgtcccccccccgatgttgcgcctctctttcccagccgggagcatatnnacctaaccctatccccccccatgtgcggacactttcctccggggattatgtccccacgcgttgagtggccgcgttcgcccctcgcgcgcccgatagagtttcccataagccgcctttatccctctcttccgttgnncnnccccctacttctcgcccactgttttccgg

SEQ ID NO: 39932 - DNA, 721 bp, Zea mays
  misc_feature: Ceres CLONE 1431208-F
  misc_feature: Encodes the peptide sequence at SEQ ID NO. 39933
  misc_feature (428)..(428): n is a, c, t, g, unknown, or other
  misc_feature (436)..(436): n is a, c, t, g, unknown, or other
tccccgcggtggcggccgctctagaactagtggatcccccgggctgcaggaattcgcacgagaccattacctagaacatcctaatcgaaaaactgcgactgtgagcttcgttcgttcagttcatccgttttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgaccccctgcactgcggcaagtgagctaggtgctccatcctgcangccgcctngagaaagctagctattattatagctaaataaagtataccgcgtcgcctgtgtgtgttcgaggcaatcagtcattaaatgcctgccatgcctggcatgctctgattctgaaataaaaatgatccctgaaaggcggccccggccccgaaacccccccttgccccctccgggcctttttggggaaaaaaatgtttttgttttgtttttgtgggtcccacccggaaaaggggaacccctggcccccgtgggtttgggcccccccccccctaaaaaactttttttccccc

SEQ ID NO: 39933 - protein, 82 aa, Zea mays
  misc_feature: Ceres CLONE 1431208-F
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHAEGGFEAAAGAENGGCKCGGNCQCDPLHCGK

SEQ ID NO: 39934 - DNA, 1018 bp, Zea mays
  misc_feature: Ceres CLONE 1431210
  misc_feature: Encodes the peptide sequence at SEQ ID NO. 39935
tcaaagaaaaagaacatattccgcataattgctctttccgccttataaaccagcggacctttttcttttcttcgaaaacactcctctaagccaccaaacacttgctatgcccgctcctccccgcgcactgctcagcacgccgtgcccgtgagaccatggacgcgagcgcggccaccggcaggcgcaagcgcaagcgccccgacgccgacatcaccggcgacgcggccgccgccgctgccgctgccgccgccccggtcgccgtcgacgaggcctcggacgccgaggtcgaggagttctacgccatcctgcggcgcatccgcgacgcctcccgccggctgtgcggcgccggcgcccggcccgccccgcgcgcgccagcgtggcggcccagcttctcctgggaggacttcgcgaccccggcccctggcgcgccggcgcctgagaccccgccccccgcgcagcaggagccggcgcagccgcggcccgacgagcctgtagccgttgtccgcgctaccgccccgtcgccgcgtgccgggctggacctgaacgcggagccggagccggaggcgccggccacccctcgctcggcgcgcgtccaggcgtagcgtagcgcgcggcgcatcgtcacctgcctcctgcaccgcgccagccaaggagagccgtagcgtggggccgttgggcgcgcgcgtcagctcggctgctgctgggaggtggctggcccggtgagtcggtgatgtcagccgagagccgacggtggtcgcaatcgtccgcggcggcagcacagcacagcacacacagtgcgtaccttcccctcggtgaattactgatacgaatccccatcatgtaatcgtatttttttagtggctctctttggtgcgctgctccgtgtggacaggtgagactggttcgttgctttggttgcaggaaaaataccttttaatcggagcagttgatgtaccgtccgaaaaaaatgacgtgtttaactattcgttgcgttttatgtataaaaaaaaaaaaaaaa

SEQ ID NO: 39935 - protein, 148 aa, Zea mays
  misc_feature: Ceres CLONE 1431210
MDASAATGRRKRKRPDADITGDAAAAAAAAAAPVAVDEASDAEVEEFYAILRRIRDASRRLCGAGARPAPRAPAWRPSFSWEDFATPAPGAPAPETPPPAQQEPAQPRPDEPVAVVRATAPSPRAGLDLNAEPEPEAPATPRSARVQA

SEQ ID NO: 39936 - DNA, 715 bp, Zea mays
  misc_feature: Ceres CLONE 1431212-F
  misc_feature: Translation starting site: 217
  misc_feature: SWISSPROT Homolog: EC 3.7.1.2 Fumarylacetoacetase
  misc_feature (477)..(477): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (491)..(491): n is a, c, t, g, unknown, or other
  misc_feature (495)..(495): n is a, c, t, g, unknown, or other
  misc_feature (500)..(500): n is a, c, t, g, unknown, or other
aagctggagctccccgcggtggcggccgctctagaactagtggatcccccgggctgcaggaattcgcacgagaccattacctagaacatcctaatcgaaaagttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccggcggggggtgcaggcgcaggcgccgcgccccgcggtggccatcggggacttcgcgctcgacctcgccgccgtcgccgacgcggggctcttcgacgggcccgcgctctccggctccccgtgcttccacaggagacgctcaacatgttcttggggatgggcccgcccngctgaannngagcncgcnccacnctacagaaaatctatcagccgacgagcccgtcttggtgacaaccagccactgagaaccagtgtctggctccatgattgattagagattgttctaccaaccccgttgggagttacacggacttcttttgtcctgggcccaggcaggaatgggggatcactttcgagggcccaaactccggtaacccaattgttttttcttccaaaggaacaagggg

SEQ ID NO: 39937 - DNA, 704 bp, Zea mays
  misc_feature: Ceres CLONE 1431215-F
  misc_feature: Encodes the peptide sequence at SEQ ID NO. 39938
  misc_feature (591)..(591): n is a, c, t, g, unknown, or other
tccccgcggtggcggccgctctagaactagtggatcccccgggctgcaggaattcgcacgagaccattacctagaacatcctaatcgaaaaagagcaggtttgccttcgccttcacaattcgcaccacattattgtcttgtgttgcccgcaacccaaagcggatcaaaccctagatctcgtccccgttcctccgatcctcatggattcctcctcctcctcgtccagcctgagccagcagcccgagttcgattacctcttcaagctgctgcttatcggcgactccggcgtcggcaagagcagcctcctcctccgtttcaccgccgactcctttgaggacctttcccccaccataggtgttgacttcaaggtgaagatggttaccattggtggcaaaaaactcaagcttgccatctgggacacagccggacaagagagatttaggaccttgaccagctcttactacagaggggcacagggggttattatggtgtatgatgtcactcggcgggaaacgtttactaatctttctgatatatgggccgaggaaattgaccctgtatcaaccaccaggactgtataaagatgcttgntggaaataagtaaataaggaaagtggaaagactgtgaacaaaaaggaggggattgatttgcctgggaaaaccgtttgtttgttctaaaatggagggcaaaacaaaagtaaatg

SEQ ID NO: 39938 - protein, 126 aa, Zea mays
  misc_feature: Ceres CLONE 1431215-F
  misc_feature (21)..(127): Pfam Name: Ras Pfam Description: Ras family
  misc_feature: SWISSPROT Homolog: EC 2.7.11.1 Non-specific serine/threonine protein kinase
MDSSSSSSSLSQQPEFDYLFKLLLIGDSGVGKSSLLLRFTADSFEDLSPTIGVDFKVKMVTIGGKKLKLAIWDTAGQERFRTLTSSYYRGAQGVIMVYDVTRRETFTNLSDIWAEEIDPVSTTRTV

SEQ ID NO: 39939 - DNA, 721 bp, Zea mays
  misc_feature: Ceres CLONE 1431225-F
  misc_feature: Encodes the peptide sequence at SEQ ID NO. 39940
  misc_feature (351)..(351): n is a, c, t, g, unknown, or other
cgcggtggcggccgctctagtactagtggatcccccgggctgcaggaattcgcacgagaccattacctagaacatcctaatcgaaaagaaccaaaaaataaccagacaatgagcttaacgcttctccagggctactcctccgctgaggacgacgacgatcccgccgccggcgccggcgctggcaccgagctgagcgagtctggtgattcgtcagccgaggaagccggatcggacgaagacgaggagtccgctcctccaaagccgccccccaagctccgccgccgaccaaaccctaaggggggagatgccggcggcagcgacgggggctccttgctgccctccgcgctggangccttcgctgatgtctcgggaccacagattttttgaggcacggggttgccgagccagaggaagggacggaggccctcggtgtactccatcgcccgggggaaagaggggaaccaaaccgccgccctcccgggggttggtgggggggaaaacccccaaatatttcttttcccgggagggatttccccaattgggccccccccccccgggtttcggggccccctttcctttttgtggaaaaaagaaaataaaggggttgtaaatccggtgcccaaaaaacccctttattttttaggaggggttccccagggggggcgcccaaacaccttttctcgggggagggggggggggcccccccccggggggggagaac

SEQ ID NO: 39940 - protein, 92 aa, Zea mays
  misc_feature: Ceres CLONE 1431225-F
  misc_feature (81)..(81): Xaa is any aa, unknown, or other
MSLTLLQGYSSAEDDDDPAAGAGAGTELSESGDSSAEEAGSDEDEESAPPKPPPKLRRRPNPKGGDAGGSDGGSLLPSALXAFADVSGPQIF

SEQ ID NO: 39941 - DNA, 698 bp, Zea mays
  misc_feature: Ceres CLONE 1431232-F
  misc_feature: Encodes the peptide sequence at SEQ ID NO. 39942
ggagctccccgcggtggcggccgctctagatctagtggatcccccgggctgcaggaattcgcacgagaccattacctagaacatcctaatcgaaaagaccactgcgactgtgagcttccttcattcaattcatccgtgttcttgtttgccacgcgcaaagacagaggatgtcctgctgcatatgctactgtgggtgcggctccggctgaaagtgccgcaacggctgtcgatgatgcagtaagatgtacccggacatggatgcactcgtgaccaccaccccccaggatctcatcatggatgccccaccgtccaaggcgcacgccgagggcggcttccaggccgccccctcagctgagaacggaacatgcaagtgccctagcaactgccaatgcgacccctgcatctgcggcaagtgaactaggtgctccaccctgcaggccggccggaggaagctagctaattattataagctaaataaagtatagcggcttcgctgtgtgtgtttcgagtcagtcattcaaataactgcgtgccatggctggcctgctctgagtctgatatgatgatgatgcctgatggcggcgatcgtgtcctgtagtcctcccctgccccctcaggcgcttctggcagccagcactgtgttgtgtcgtgttgtgaagaatgcaacacgggtaccacgctaaccatgtgccctgctg

SEQ ID NO: 39942 - protein, 57 aa, Zea mays
  misc_feature: Ceres CLONE 1431232-F
  misc_feature (1)..(55): Pfam Name: Metallothio_2 Pfam Description: Metallothionein
MYPDMDALVTTTPQDLIMDAPPSKAHAEGGFQAAPSAENGTCKCPSNCQCDPCICGK

SEQ ID NO: 39943 - DNA, 709 bp, Zea mays
  misc_feature: Ceres CLONE 1431235-F
  misc_feature: Encodes the peptide sequence at SEQ ID NO. 39944
  misc_feature (687)..(687): n is a, c, t, g, unknown, or other
tcttaactagtggatcccccgggctgcaggatttctcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggtctccctcgccgccgccgtcttcggctacctcttctgctacatccgcgctggacacgtggttcctgctcccaaatatgattcctctggtctggcgcacgtgagcccccctcgtgcgctcgggcgtgtctccctgttcagtgttctctcgccctgtgttgatgtatggagtttgccccccgcggcctctcaaacaagaagtgctcccccctgttgggtgcgaacctctttcgccccccccccctgtttgtctgcggccgtccctggccccccccggcctgggttttcccggggtgtcaacagggatggcttctctcttcttcctggccggagaagaagtctgcccgttgtctgtaccgccccccctntccgcgatggccgccccccgcc

SEQ ID NO: 39944 - protein, 173 aa, Zea mays
  misc_feature: Ceres CLONE 1431235-F
  misc_feature (167)..(167): Xaa is any aa, unknown, or other
MAGLRMKFVAVAAMAAALVASAAAAEAPAPAPASDAAAAVPLAAVSLAAAVFGYLFCYIRAGHVVPAPKYDSSGLAHVSPPRALGRVSLFSVLSPCVDVWSLPPAASQTRSAPPCWVRTSFAPPPCLSAAVPGPPRPGFSRGVNRDGFSLLPGRRRSLPVVCTAPPXRDGRPP

SEQ ID NO: 39945 - DNA, 680 bp, Zea mays
  misc_feature: Ceres CLONE 1431242-F
acccgcggtggcggccgctctagaactagtggatcccccgggctgcaggaattcgcacgagaccattacctagaacatcctaatcgaaaaatcaggattttccttgcctctgctcgttctcatggccgagcacacctcttcctcaagtgtcgcctgctgtaccagtgtccagctccccacgcccgccgctactcctagcccctctcctccttggatttcgcccagcctccatctctctttccagccatggatgccgcccctccctagcaccctcatctccacgggagctcaccctagctccagcttcaaccatggaagggggcctctcctgcctacagcaggtcagcgccccatctcctcaacatctcggctccctgtcccatctctctctcacgagccactctcctcgttctccatgacgtcgacatggggctcgcccctgcaacctcgcctcgctgggtctcctcagggcgccggggtgttgcttcctatacatcatgcgacttcctagtgcttgctctcgccctaggccatggagcagcagcagccacgacactccttcgtgtcgcgccctcaacgtgttcgatgaaataccgcagcgagctccaactcgattttcacagcccctgcacgacgtcacaaactccgcctcgttgtccaatgtccttgctttcaggcat

SEQ ID NO: 39946 - DNA, 699 bp, Zea mays
  misc_feature: Ceres CLONE 1431264-F
  misc_feature: Encodes the peptide sequence at SEQ ID NO. 39947
  misc_feature (413)..(413): n is a, c, t, g, unknown, or other
tccccgcggtggcggccgctctagaactagtggatcccccgggctgcaggaattcgcacgagaccattacctagaacatcctaatcgaaaagacttcgccaaaaacgaaaaacctcaccggctccattccaatccatcctttccttatcccctctccctcccttcgttcgccatggcaaccgtgttcctccgttccctcgccatggccatggccgacaccgcgctcccgccctcccacaagctcctccctacggtttccctgccgctcctcccctcgtccacccgcgccgcgccgctcctcctctgcgccagccgccgcctgccgcccgcgcccctcgttgcctcatccgacgccgtcgagacgaacattgaatgggtcgacgacgacgaggaggaggctggagaagccttcnacgaggagggtggggatgttgaggaggaggtgctggcctcaggcgacgagggtgagggggagtacgccgcggtggagccgcccgaggaggcaaaggtctacgttgggaacctcccctacgacatcgaaagcgagggactcgcgcagctcttcgaccaggccggcgtcgtcgaggtcgccgaggttatttacaacaaagagactggccagagccgtgggtttggcttttgtaccatgagcactattgaggaagctgataagccattgagatgttcaaccgctatgaa

SEQ ID NO: 39947 - protein, 175 aa, Zea mays
  misc_feature: Ceres CLONE 1431264-F
  misc_feature (113)..(173): Pfam Name: RRM_1 Pfam Description: RNA recognition motif. (a.k.a. RRM, RBD, or RNP domain)
  misc_feature (81)..(81): Xaa is any aa, unknown, or other
MATVFLRSLAMAMADTALPPSHKLLPTVSLPLLPSSTRAAPLLLCASRRLPPAPLVASSDAVETNIEWVDDDEEEAGEAFXEEGGDVEEEVLASGDEGEGEYAAVEPPEEAKVYVGNLPYDIESEGLAQLFDQAGVVEVAEVIYNKETGQSRGFGFCTMSTIEEADKPLRCSTAM

SEQ ID NO: 39948 - DNA, 834 bp, Zea mays
  misc_feature: Ceres CLONE 1431275-F
  misc_feature: Encodes the peptide sequence at SEQ ID NO. 39949
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (483)..(483): n is a, c, t, g, unknown, or other
  misc_feature (555)..(555): n is a, c, t, g, unknown, or other
tagttaccccccacacccttcttctgctgctatagnaccccccnnttnctttaaaactgggactccccgcggtggcggccgctctagaactagtggatcccccgggctgcaggaattcgcacgagaccattacctagaacatcctaatcgaaaatcatttgcaaaccctgctccaactccgattcgtcactccaccctcgtcgcgccgccgccgccgccgccgcctgccgcgtccccggtcagcctcgcggcccggtggtctgctagccacagcggagagaccaggagtcatggtgatccctccaccaccaagggcagctagagtcacccgtttcctcaggccctacctattgaggatgcatttctcaaacgagtatgtatctgctcaggtcgttcactccccaacatcaactgttgcatgttctgtaatttcgcaacgagaagctgttgacactcaacatgtgagtattatccgccacctcncaccccccttgttaacatcgcgaaaggttgcttcggtgaagttcctgcctcctcaagggggataacctggcngtggtccctccgccttgaccagagagaaacaaacagtacccttgggcaaaagtggaagggcccgttataagattccttttcagagcaaacgtcggagccccagcttccccttgattcgccgccagcttaaatatcttttgtgactttagttattttggcgccgattggcttggaacgtgttgaaattttttaagctgattttattcaatggcacacagtgggcggcgtgacgtttgccctgacggttaacaacattttttggtgcccacactgctagat

SEQ ID NO: 39949 - protein, 85 aa, Zea mays
  misc_feature: Ceres CLONE 1431275-F
  misc_feature (65)..(65): Xaa is any aa, unknown, or other
MVIPPPPRAARVTRFLRPYLLRMHFSNEYVSAQVVHSPTSTVACSVISQREAVDTQHVSIIRHLXPPLLTSRKVASVKFLPPQGG

SEQ ID NO: 39950 - DNA, 698 bp, Zea mays
  misc_feature: Ceres CLONE 1431296-F
  misc_feature: Encodes the peptide sequence at SEQ ID NO. 39951
  misc_feature (386)..(386): n is a, c, t, g, unknown, or other
  misc_feature (513)..(513): n is a, c, t, g, unknown, or other
tccccgcggtggcggccgctctagaactagtggatcccccgggctgcaggaattcgcacgagaccattacctagaacatcctaatcgaaaaccgggttctggctcgccaaaccctagccgccgagtgccgcccaccgcccgcccgccctccgccgcgcgtcggacggtgccgagggaagaggcaccatgaggttggagaagtgctggttctgctcctctaccatctaccccggccatggaatccagttcgtccgcaacgacgccaaggtcttccgcttttgccggtcaaagtgccataaaaacttcaagatgaagaggaaccctcgtaaggttaagtggacaaaagcatacaggcatttgcatggcaaggacatgacccaggatancacctttgagtttgagaggaagaagaacaggcccgagcgctacgacccgcatttgacggagcagactctgaaggctatcccgcttatgcaaagataggcatgaccgtatgggaaacccatctcaacngacataaacctggtaaacccaggagattgaaaaagactccagggacttggagcagaacatcgcctgctcccgaaaagctttattatcccctcccccgggctaaaaaacgaaggtcaggtttaaatttttcccccccccacaaaaaaaaccccctttgaaaaaaaggcgggggctttttggggctt

SEQ ID NO: 39951 - protein, 98 aa, Zea mays
  misc_feature: Ceres CLONE 1431296-F
  misc_feature (1)..(71): Pfam Name: Ribosomal_L24e Pfam Description: Ribosomal protein L24e
  misc_feature (67)..(67): Xaa is any aa, unknown, or other
MRLEKCWFCSSTIYPGHGIQFVRNDAKVFRFCRSKCHKNFKMKRNPRKVKWTKAYRHLHGKDMTQDXTFEFERKKNRPERYDPHLTEQTLKAIPLMQR

SEQ ID NO: 39952 - DNA, 750 bp, Zea mays
  misc_feature: Ceres CLONE 1431309-F
  misc_feature: Encodes the peptide sequence at SEQ ID NO. 39953
  misc_feature (255)..(255): n is a, c, t, g, unknown, or other
  misc_feature (289)..(289): n is a, c, t, g, unknown, or other
  misc_feature (290)..(290): n is a, c, t, g, unknown, or other
  misc_feature (304)..(304): n is a, c, t, g, unknown, or other
  misc_feature (305)..(305): n is a, c, t, g, unknown, or other
  misc_feature (333)..(333): n is a, c, t, g, unknown, or other
ctggagctccccgcggtggcggccgctctagaactagtggatcccccgggctgcaggaattcgcacgagaccattacctagaacatcctaatcgaaaaagttcagcctcggctggacatcgagtttgtaccgggaaacagcttggtagtataaccactgaagatggtcagtgggaggccgcatggtgaattggactcatggttcaagagcctcatggtgacctctagcagcgagagggggcaggctgggagtggntgtccagcgccacattacaggatggaaggacttnncgatgagctcctgnntgcgatatatccacagttgaagatgatnagatggtcatcgtggcgtctggttgttgcccaagcttgcttgacgcgctgggatgggggtcactaatctttcctttactggggaacctggggctgaaaaatttagggattcccttgccccaattccacaagtttgaattttcactctcgggaaaaaaacccccttttaaaaaggcccaaaaaggttttcccccccccgcccggcccccggggggtaacccccccaaatttttttcaccccccccccccgggggggggcccccccccccattccccccaagaggaaggaaatatccccccccccggcggcgctttttttaacccggggggggaagaaaaacaccggtacccaaaatataatggggggaaccccccccctttccccccgggggaaaaaaaaaaaacccccccttccttt

SEQ ID NO: 39953 - protein, 78 aa, Zea mays
  misc_feature: Ceres CLONE 1431309-F
  misc_feature (43)..(43): Xaa is any aa, unknown, or other
  misc_feature (48)..(48): Xaa is any aa, unknown, or other
  misc_feature (57)..(57): Xaa is any aa, unknown, or other
MVSGRPHGELDSWFKSLMVTSSSERGQAGSGCPAPHYRMEGLXDELLXAIYPQLKMXRWSSWRLVVAQACLTRWDGGH

SEQ ID NO: 39954 - DNA, 699 bp, Zea mays
  misc_feature: Ceres CLONE 1431313-F
  misc_feature: Encodes the peptide sequence at SEQ ID NO. 39955
  misc_feature (392)..(392): n is a, c, t, g, unknown, or other
tcgagctggagctccccgcggtggcggccgctctataatagtggatcccccgggctgcaggtattcgcacgagaccattacctagaacatcctaatcgaaaatattattgaatggtgctgttagaaagggagaacgcttagttccccctgtttcatttgacttgttcatgagagccacatttcctgtttctaatgctcgagtgaaggctacagaaaggtttgaagcagcctacccaataatcaaggagttggctcttgccggtcctcctggctcaaaaactgtgaaacaagcatcacaacagcttttacctttgtgtgcaaaagcaatgcaagaaaacaacgcagagctcaccagggaggctgttgatgttttcatttggtgcttaactcanaatgcagagtcttactagcagtgcccaaagaatttatcttgaaaatattgaagccagtgttgctgtcctgagcaaagttgtgattgattggagggatgtgtctcctaacctcagttctgaagctctcaaggcaacatggaagaactttaaggcttaaaaatgaggctgcgctggactcccacaacagatgcttggaaaagcaggcatcttttcaaagaaagcagaaacagcacttgcaagggcgaatcttttgaaaaagctgaacccgtgggcccccacccttgcctgaaaaagccagccttggttg

SEQ ID NO: 39955 - protein, 80 aa, Zea mays
  misc_feature: Ceres CLONE 1431313-F
  misc_feature (75)..(75): Xaa is any aa, unknown, or other
MRATFPVSNARVKATERFEAAYPIIKELALAGPPGSKTVKQASQQLLPLCAKAMQENNAELTREAVDVFIWCLTXNAESY

SEQ ID NO: 39956 - DNA, 743 bp, Zea mays
  misc_feature: Ceres CLONE 1431319-F
  misc_feature (283)..(283): n is a, c, t, g, unknown, or other
  misc_feature (349)..(349): n is a, c, t, g, unknown, or other
  misc_feature (353)..(353): n is a, c, t, g, unknown, or other
cgcggtggcggccgctctagaactagtggatcccccgggctgcaggaattcgcacgagaccattacctagaacatcctaatcgaaaaaccaaaccaccgttctaaacgctcccctagtcccctgctcagcttctccagagatcgccaaagaagcagcatcggcagtaagctctgcggcgatggggtacacgtacactccgacatactactcgggcctgcaggacaccatcgcgtcgctctgcaagtccatcctgccctccttccgcgtggggcggcggctcanccgcgaacaaagcgcgcgcggcgccacgccgagcagctcaagtggcagcaggagtccttccaccgnatcnttcacctcgccggcgctcaacgcgagggcatcgctcccggctccgaaggttgccgcctttccgcggaaccatggttgggggggttgtttcggccccccaaaaaccttaagaaaccgctttgggtcccggaaaaactcctttttctccaggacccccttaacccaagggggttccccggggaaaaaaaacgtccaaggggccccccgggggagggcccccccgtttgggttcttccaaaagcccccaaccagaagtttcccggagagggggggggaaaaaaatcaccgtggggccccccctcccccccgggggggggggccccaaaaaaaaaaaaaaagggtgttttcctctcggggaaaaaaaaaacataaaaaggggcgggggttccca

SEQ ID NO: 39957 - DNA, 637 bp, Zea mays
  misc_feature: Ceres CLONE 1431354-F
  misc_feature: Encodes the peptide sequence at SEQ ID NO. 39958
  misc_feature (637)..(637): n is a, c, t, g, unknown, or other
aagctggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatgccatgaaccggcgagcccccn

SEQ ID NO: 39958 - protein, 45 aa, Zea mays
  misc_feature: Ceres CLONE 1431354-F
MPTRNHNAAAAAAPQHHHHNRGGAPALGKSKAVPGRADAMNRRAP

SEQ ID NO: 39959 - DNA, 618 bp, Zea mays
  misc_feature: Ceres CLONE 1431366-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctggagctccccgcggtggcggccgctctagaactagtggatcccccgggctgcaggaattcgcacgagaccattacctagaacatcctaatcgaaaactctgctaacgccgctcggcgcatctattgcctcgcgccacgtcgccgcgctgcagcgagccacggcctggcgtcgctgaggagacacaaagcaccgcatgggcgtatgcacagcgcggggagggtatctcttcatcggggctgcgtaaaaaaggactcctccaattgggtcaggaaagcttcccccgaggtggaggaaaagattccccgggtgtccaaaaaaggcccaaacccccccccaaaaatggggttttcgttcccggaaccaacaaggggatccccccttttttaaaaaaggttaatttggggaaaaaaaaactccccccctcccctcaagcccctttgggtgtgtccccccaaaaacccccgggggaaatttcctcctttcccctttataaaaaaggggggggggggatt

SEQ ID NO: 39960 - DNA, 639 bp, Zea mays
  misc_feature: Ceres CLONE 1431376-F
  misc_feature (639)..(639): n is a, c, t, g, unknown, or other
aagctggagctccccgcggtggcggccgctctagaactagtggatcccccgggctgcaggaattcgcacgagaccattacctagaacatcctaatcgaaaaattctcgatccctctacctctcgcatccggtgcctggctgccagccccagcgctcgccaacctcatcttccccggcgtttcctcctagctccctccaccatgccgctgccatggaactcactgctcggccgcgccctggccatgctccctgcgctcgccagccgtgcgcatctccctctgcgcgcgctcctacgtcctgcgccgcgaaccccgctgtggagcttccccgagctcgccccatggcgcccggccgagctcctccctgccgtgttcttgctcggcgtccagttttcctgtgtgccgcggtcttcctccccgagctcaccccagccccttgtattccccatggccggagcttcttccagctccagctcggctccctctcccatggctctctgcgcgctagccgctgtgcgcccatctatctctcgtggatctccctccccagctcctctctgctcgcgccgtcgcccagcctgttggcacacgcactcctctgtcgcacgctcctccaagtcagagctccctctggccgttn

SEQ ID NO: 39961 - DNA, 638 bp, Zea mays
  misc_feature: Ceres CLONE 1431394-F
  misc_feature: Translation starting site: 306
  misc_feature (400)..(400): n is a, c, t, g, unknown, or other
  misc_feature (419)..(419): n is a, c, t, g, unknown, or other
agctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggcaatgggaccgtcctactgctcttcggtgggggggtggctacgttcatccncatctggaaaaaggggtcngtggaccaatactcgcccatcccgtacgtggcgacgctgctgaactgcatgatgtggggtgttgtacgggctgcccgctggggcacccccacagatgctggtgatcaccatcaacggaaccggaatgctcttccacttgaactacgtggcgctcttctcctccactccccgggggggggccccccccaaagtgtcccccccggtgcgctgccaaggtcg

SEQ ID NO: 39962 - DNA, 410 bp, Zea mays
  misc_feature: Ceres CLONE 1431404-F
caccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaacctacacacgggatgctactaactagcttgcaggcaagggccaaggaaatgggcaagcccttttcatgtgctctcgggcggaaacggggttttttccgtttttccgggggccttttgtcccccccaaaaaa

SEQ ID NO: 39963 - DNA, 648 bp, Zea mays
  misc_feature: Ceres CLONE 1431412-F
  misc_feature: Encodes the peptide sequence at SEQ ID NO. 39964
aaagctggagctccccgcggtggcggccgctctagaactagtggatcccccgggctgcaggaattcgcacgagaccattacctagaacatcctaatcgaaaaaccagtctcgtcgtgtccgttcgcgatcgggcaaacctgcaaccctttcctcttcgtccccccgctatctcgttgccccaagccggagtacggagtacggcagtcgcacccccgtcgtcccgttccttgctcgccccaacttcgccgccgcatccccctcggctgctcgctcctcgtctgcccctagtgatgtctggtggtaacgcgtggtcgccgctcccttcgcacggatttgacgacgactcctgcttgctcttttttattttgctcgtgtcgtcggatcgtggcttgattgatctccgcatcccgcagatccgactccggcggcatggggagccgcgcaggcgagcctgtggcgaggaccaacagcggcggcggcagcagcagcaaggattcgggcagcttcgagtgcaacatctgtctggacctggcgcaggatcccgtggtcaccctctgcggccacctcttctgctggccatgcctctacgagtggctccacgtgcacgcgcactcccaggagtgtcccgtctgcaaggccgtcgtcga

SEQ ID NO: 39964 - protein, 72 aa, Zea mays
  misc_feature: Ceres CLONE 1431412-F
  misc_feature (28)..(68): Pfam Name: zf-C3HC4 Pfam Description: Zinc finger, C3HC4 type (RING finger)
MGSRAGEPVARTNSGGGSSSKDSGSFECNICLDLAQDPVVTLCGHLFCWPCLYEWLHVHAHSQECPVCKAVV

SEQ ID NO: 39965 - DNA, 682 bp, Zea mays
  misc_feature: Ceres CLONE 1431413-F
  misc_feature: Translation starting site: 301
  misc_feature (313)..(313): n is a, c, t, g, unknown, or other
  misc_feature (380)..(380): n is a, c, t, g, unknown, or other
  misc_feature (397)..(397): n is a, c, t, g, unknown, or other
  misc_feature (415)..(415): n is a, c, t, g, unknown, or other
  misc_feature (439)..(439): n is a, c, t, g, unknown, or other
  misc_feature (464)..(464): n is a, c, t, g, unknown, or other
  misc_feature (467)..(467): n is a, c, t, g, unknown, or other
  misc_feature (468)..(468): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (494)..(494): n is a, c, t, g, unknown, or other
  misc_feature (499)..(499): n is a, c, t, g, unknown, or other
  misc_feature (506)..(506): n is a, c, t, g, unknown, or other
  misc_feature (515)..(515): n is a, c, t, g, unknown, or other
  misc_feature (528)..(528): n is a, c, t, g, unknown, or other
  misc_feature (529)..(529): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (589)..(589): n is a, c, t, g, unknown, or other
  misc_feature (595)..(595): n is a, c, t, g, unknown, or other
  misc_feature (600)..(600): n is a, c, t, g, unknown, or other
  misc_feature (602)..(602): n is a, c, t, g, unknown, or other
  misc_feature (603)..(603): n is a, c, t, g, unknown, or other
  misc_feature (616)..(616): n is a, c, t, g, unknown, or other
  misc_feature (620)..(620): n is a, c, t, g, unknown, or other
  misc_feature (621)..(621): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
agagctggagctccccgcggtggcggccgctctagaactagtggatcccccgggctgcaggaattcgcacgagaccattacctagaacatccctaatcgaaaaattaaactcggcgaacgggccaagaaaagcaaaccgagggaggagaaaggcaaggaaagtgggaaggtaggagagagagggagacagggaaagctctcttcctcctcctcctcctctcgaattccgtctcttgtccctgtcgtcctcgcccggtttccccggtttttgagaggggaaagaggaggcggaggagagggatggggagggacnagaggttcccggtgtgggaggccgcgctcggcgccggagtcgccgccgccttcgccgctgggatccnccggggggggggttccntgccggattccgactacngctgtcctcaggttgcccggaagngtggaggaaattccaaaccctcagnggnncagttgggagaacattannnnnnnantatcnccctacnggtgttggnaagggaatttgcnncgcggcccgtgntnnnnaagcagccggcnnnnncccccccggcggnnnnnnnnnnnnngntggtgncgctngnncctcccatcgagncaanncggcccggcctctcctcccgcannnnaccgtggggttcccagtggtccttcgtgtgcctgg

SEQ ID NO: 39966 - DNA, 577 bp, Zea mays
  misc_feature: Ceres CLONE 1431415-F
  misc_feature: Encodes the peptide sequence at SEQ ID NO. 39967
  misc_feature (385)..(385): n is a, c, t, g, unknown, or other
  misc_feature (389)..(389): n is a, c, t, g, unknown, or other
tggcggccgctctagaactagtggatcccccgggctgcaggaattcgcacgagaccattacctagaacatcctaatcgaaaaagttctactccccgctccccattcacgcactctcactctacctccctccctccctcgccggcgccgcgcgtgctcccgcgggatgctgcgtgcggcgcggtacctgctggggtcgccgggcgcgagcgggttcgggtccaggtcgacggcggaggaggtgaccccggacctgggcgcgacgacggccatcatcacgggcgccacgtccgggatcggcgccgagacggcgcgcgtgctggcaaagcgcggcgcgcgcgtggtgatcccggcgccggagcgccaaggcggcggaagacgtgcgcncgcncatcttggccgaatgccccgccggcgcccgtcctcgtggctcccgctcgacctcagcttcgctcgggttccggggcgcccctttcgccgaaagggtttcctagggggtttggggcctccccggttcccccttccttaatgggaccgtacctttcccttccaaatgggggggccccccgcccccccccc

SEQ ID NO: 39967 - protein, 120 aa, Zea mays
  misc_feature: Ceres CLONE 1431415-F
  misc_feature (74)..(74): Xaa is any aa, unknown, or other
MLRAARYLLGSPGASGFGSRSTAEEVTPDLGATTAIITGATSGIGAETARVLAKRGARVVIPAPERQGGGRRAXAHLGRMPRRRPSSWLPLDLSFARVPGRPFRRKGFLGGLGPPRFPLP

SEQ ID NO: 39968 - DNA, 653 bp, Zea mays
  misc_feature: Ceres CLONE 1431420-F
  misc_feature: Encodes the peptide sequence at SEQ ID NO. 39969
  misc_feature (497)..(497): n is a, c, t, g, unknown, or other
  misc_feature (498)..(498): n is a, c, t, g, unknown, or other
  misc_feature (537)..(537): n is a, c, t, g, unknown, or other
  misc_feature (653)..(653): n is a, c, t, g, unknown, or other
aagctggagctccccgcggtggcggccgctctagaactagtggatcccccgggctgcaggaattcgcacgagaccattacctagaacatcctaatcgaaaaatgctatgcgcttcctccacatacaagaccaccgcagatcaaaacacacatctctctcactcactcactcgcctcactccactggacatccatccatggagctcttcgcagcagcagcatcagccgaggatcagaagccgtgcagcagcaggctgttcagcaggaagaggagcggcggcaaggcgggcatgggcgtgcgcggcgccgacaagggccggtcgtccttctccgggcggtgcgcgcggctcgtcaaggagcagcgcgcgcggttctacatcatgcgccgctgcgtcacgatgctggtgtgctggcgcgagtacgcctgacgcctgagccctcggtgtccctgatgcaatggcgccggacatgatgcggagccgcatgcaggacgcgacnncaagcccaaagggaaaagaagaagaaggaagggaagccnccgccgccgccgagcaggtcaagagacgctcgatccgcctccgcggtcttaattagggaaccacgaacgaaccttgtgtaaagagaagattattattttttttattattttctctn

SEQ ID NO: 39969 - protein, 76 aa, Zea mays
  misc_feature: Ceres CLONE 1431420-F
  misc_feature (53)..(71): Pfam Name: DVL Pfam Description: DVL family
MELFAAAASAEDQKPCSSRLFSRKRSGGKAGMGVRGADKGRSSFSGRCARLVKEQRARFYIMRRCVTMLVCWREYA

SEQ ID NO: 39970 - DNA, 638 bp, Zea mays
  misc_feature: Ceres CLONE 1431428-F
  misc_feature: Encodes the peptide sequence at SEQ ID NO. 39971
agagctggagctccccgcggtggcggccgctctagaactagtggatcccccgggctgcaggaattcgcacgagaccattacctagaacatcctaatcgaaaaaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccatcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccaactgctagcagtgtgctagccaagccaagccaagcaggaaggcccccggcattgctagctgtacgtgtctgagtgtgcatctgcagcagggtgcatgcaggagaccgtacgtacgtgtctctttctctctctcg

SEQ ID NO: 39971 - protein, 115 aa, Zea mays
  misc_feature: Ceres CLONE 1431428-F
  misc_feature (41)..(115): Pfam Name: Tryp_alpha_amyl Pfam Description: Protease inhibitor/seed storage/LTP family
MAATSSKSSSSSSSAQRAAAALLVAAAVAVSILVVGAAAVCDMSNEQFMSCQPAAAKTTDPPAAPSQACCDALAGADLKCLCGYKNSPWMGVYNIDPKRAMELPAKCGLATPPNC

SEQ ID NO: 39972 - DNA, 791 bp, Zea mays
  misc_feature: Ceres CLONE 1431449-F
  misc_feature: Encodes the peptide sequence at SEQ ID NO. 39973
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (29)..(29): n is a, c, t, g, unknown, or other
  misc_feature (33)..(33): n is a, c, t, g, unknown, or other
  misc_feature (46)..(46): n is a, c, t, g, unknown, or other
  misc_feature (333)..(333): n is a, c, t, g, unknown, or other
  misc_feature (402)..(402): n is a, c, t, g, unknown, or other
  misc_feature (405)..(405): n is a, c, t, g, unknown, or other
  misc_feature (468)..(468): n is a, c, t, g, unknown, or other
  misc_feature (488)..(488): n is a, c, t, g, unknown, or other
  misc_feature (489)..(489): n is a, c, t, g, unknown, or other
  misc_feature (528)..(528): n is a, c, t, g, unknown, or other
ggtggtggtgcnnncnnnnncnncctccncccnttcttcccgcganaagcgggggggaaaggtggggctccccgcggtggcggccgctctagaactagtggatcccccgggctgcaggaatgtcgcacgagaccattacctagaacatcctaatcgaaaaaactactccgtcactttgtttgcaaaggtcctcctccatccatcgatcactgcaccggccggaggcaccgcgctcgcacggggctagccagcgagacggcagctatggcggaccgtgagcgcagtggcatctacgggggcgcccacgccacctacgggctgcagcaggaccanagaggatgcggacacccgatgggtgaccacgggaagggcatgctccacgacaacgggccgacggcgtcncangcgctgacggtggtgacgctgttggtgctggcccgggtgctgttggtgctgtgtggggtggcnccccaccgcccccctccgtnngactggcccgtggccacgccgatgttcctgatctttgancgcccatgctcgttccccaccgctgctgcttcttcgggtaccgccggtgatggggattacttcacgggcggagcgcccgtgcgtaactcgagggaacacagatcctccgctccgcgcgaatctccgggggcacacggtgaccgggaaggggtggcccagacgccaaccccgaataccttgggttggtaggaaaaggccccgccggccttcgtatggggctggcagaggcggacgtgacggcaaagggggggtccccccgagaa

SEQ ID NO: 39973 - protein, 150 aa, Zea mays
  misc_feature: Ceres CLONE 1431449-F
  misc_feature (23)..(23): Xaa is any aa, unknown, or other
  misc_feature (47)..(47): Xaa is any aa, unknown, or other
  misc_feature (75)..(75): Xaa is any aa, unknown, or other
  misc_feature (88)..(88): Xaa is any aa, unknown, or other
MADRERSGIYGGAHATYGLQQDXRGCGHPMGDHGKGMLHDNGPTASXALTVVTLLVLARVLLVLCGVAPHRPPPXDWPVATPMFLIFXRPCSFPTAAASSGTAGDGDYFTGGAPVRNSREHRSSAPRESPGAHGDREGVAQTPTPNTLGW

SEQ ID NO: 39974 - DNA, 634 bp, Zea mays
  misc_feature: Ceres CLONE 1431464-F
  misc_feature: SWISSPROT Homolog: EC 3.1.2.15 Ubiquitin thiolesterase
  misc_feature (634)..(634): n is a, c, t, g, unknown, or other
ccgctctttaacagtggatcccccgggctgcaggatttcgcacgagaccattacctagaacatcctaatcgaaaatctctccgatcggatgaaaacttcaacagattggtatgagctcctgaacgttgtagtttatcttcgcttatcgttatcttcttcgattccgtctcgaattttgaattgatgattctccttatttcatcggaagcatcgaggatttggagattacgaatcttttgatccgatcaaacgttggagcctcttcagataaagtagaatgagtagaaaaagagcagaaaatgacactgagtcaggatcaggaacagccactccggtggatagattcgggttcctgaagcaagaacatgccagcaaggctagaacaacaacaacatcatcatccactgaccaggacagagaggagagaaaagtgaggaaatggaggaagatgattggggttggaggcagtgactggaagcattacgttagaaggaaacctaacgttgtcaagaggcgtatacgcaaagggatccctgattgtttaagaggtcttgtttggcagttgatctctggaagccgcgaccttttgcttatgaatcctggtgtttatgagcaactggtgatttatgagacn

SEQ ID NO: 39975 - DNA, 654 bp, Zea mays
  misc_feature: Ceres CLONE 1431470-F
  misc_feature: Encodes the peptide sequence at SEQ ID NO. 39976
aagctggagctccccgcggtggcggccgctctagaactagtggatcccccgggctgcaggaattcgcacgagaccattacctagaacatcctaatcgaaaaacttcattccggattccggatggcttacctcccatcgacggtcggtgagccgttggtgcactggcgagacagcgggtgcgctgggcaagagcaggagaccaagaatatgagcacgctggacacgcggacgctcatggacaagctgaccaccatggacaggaattgcctcgtggacctcggccacccgctgctcaaccgcgtcgccgacagcttcatcctctccgctggggtcagggcggtcagggccgtctccacggagggctacgtcatcaccttcaactggctttcgagaaactcctcctggctatacgccgacgggggctagcgcacccatttctcccccttcatacgtgacgacaggcagacgtcgctcaacactttgtcaaaaacggtcgcgcaggaggccttcctgtgggggttggcagccggattctactcatggctcacgtacgcgctgctggaggccaaggcatgccactactggaacaacagcgccctcgcaagcgccatcgctggcgcggcggtggcactcacggatgatcccagcggtctc

SEQ ID NO: 39976 - protein, 101 aa, Zea mays
  misc_feature: Ceres CLONE 1431470-F
MAYLPSTVGEPLVHWRDSGCAGQEQETKNMSTLDTRTLMDKLTTMDRNCLVDLGHPLLNRVADSFILSAGVRAVRAVSTEGYVITFNWLSRNSSWLYADGG

SEQ ID NO: 39977 - DNA, 649 bp, Zea mays
  misc_feature: Ceres CLONE 1431472-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (154)..(154): n is a, c, t, g, unknown, or other
  misc_feature (155)..(155): n is a, c, t, g, unknown, or other
  misc_feature (327)..(327): n is a, c, t, g, unknown, or other
  misc_feature (359)..(359): n is a, c, t, g, unknown, or other
  misc_feature (360)..(360): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaactggagctccaccggcggtggnncggccgctctagaactagtggaatccccccgggctgcaggaattcgcacgagaccattacctagaacatcctaatcgaaaaacatcgacccagccatctcctcaccctcgttcacacacagtcccgcactcctttagtagcttgtgattgtacgtcgacgagatcactggtncggtggcgaagacgacccatggggaaaggtanntgtgggtgcatcatggtggggggttcctccggttccccgggttgcttgcttgtcctaaacaacccccgcccgggcccaaaaaacggattggtccaaaacgggaaccccaagggagaaacttggggtggggaaaaacacggcttgcgaaatggggaaaaccggaaaagggaacccccccccgcaaaaaaggggaaattccaaaaaagggaaggccccccaagggggcccccacaaaaatttaaaacgggggggaaaaaaaaggagaaacacgggggggggggaaaccccc

SEQ ID NO: 39978 - DNA, 653 bp, Zea mays
  misc_feature: Ceres CLONE 1431477-F
  misc_feature: Encodes the peptide sequence at SEQ ID NO. 39979
tggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggtgatggaactacaactgcctctgttctcgctagggagatcatcaaattgggcatgttgagcattacttcaggggcaaatccagtgtccgttaagaagggcatt

SEQ ID NO: 39979 - protein, 165 aa, Zea mays
  misc_feature: Ceres CLONE 1431477-F
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMLSITSGANPVSVKKGI

SEQ ID NO: 39980 - DNA, 620 bp, Zea mays
  misc_feature: Ceres CLONE 1431486-F
  misc_feature: Encodes the peptide sequence at SEQ ID NO. 39981
  misc_feature (528)..(528): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcaaaaatcggtgtgcttatgcgtaagttcgtgcatcggcgcacgtatggctcctaacacctccttgctcgtgctcctcttcctcctgcccgccgccgccaccgccgccgcaccggctaccggcaacaccgccttcaacgtgacggagatcctcggccggtacccggagttcaagctcttcaacctcctgctctccaagacccgcgtcgcgcgcgaggtcaacagccggagccccgtgaccgtgctcgtcccgggcaactccgcggtggactggctcctccgccgcagcgccaggctgccgcgcgccgcgctcgtggagctcgtctccgtgcacgtcgcgctggactacatcgacgcggccaagctggcgtcgctgccccggggccagcccaccgtggtcaccacgctgttccagaacacggggagcgcgctncgccgcacgggggttcctgaactcacccgccccgggcgttgcggcncaagcgccttcttcttctcggcgcccggggtccctggtcacccccc

SEQ ID NO: 39981 - protein, 159 aa, Zea mays
  misc_feature: Ceres CLONE 1431486-F
  misc_feature (145)..(145): Xaa is any aa, unknown, or other
MAPNTSLLVLLFLLPAAATAAAPATGNTAFNVTEILGRYPEFKLFNLLLSKTRVAREVNSRSPVTVLVPGNSAVDWLLRRSARLPRAALVELVSVHVALDYIDAAKLASLPRGQPTVVTTLFQNTGSALRRTGVPELTRPGRCGXSAFFFSAPGVPGHP

SEQ ID NO: 39982 - DNA, 626 bp, Zea mays
  misc_feature: Ceres CLONE 1431493-F
  misc_feature: Encodes the peptide sequence at SEQ ID NO. 39983
  misc_feature (287)..(287): n is a, c, t, g, unknown, or other
  misc_feature (288)..(288): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaaaccacacttattagcttcctaatttcaattattgtatttcagtcgagttgctaaacaacacgaactcagtcgtttgagttttgaggaggcaagcaagaggacccatcgatggcctccttgaagaaccactgtgccgtggtggcagcagttgtagtggcgatctgcttcgtcgtcctcgccgccgnnctcccttcgcatgcgtcgacggcggtggacgagccggcgaagtataagcccagcagggcgccagcgccgtcccctgcatctgcatcatcatcctacgtcccgccgccggtccagcccgtgatcgtcgtccannncgtcatctactgcaagtcctgcaagctcaggggctacaacagcggcatggacgcgtcccctctccccaatgcgacggcgagcctggtgtgctacggcgacgcggagagcaagnnnngggtgctgaaccagacgagcacggccaccgacacgaacggctacttcatcgtgatggtgtacgacgtgggcatgttcgacccgcgcan

SEQ ID NO: 39983 - protein, 138 aa, Zea mays
  misc_feature: Ceres CLONE 1431493-F
  misc_feature (26)..(26): Xaa is any aa, unknown, or other
  misc_feature (70)..(70): Xaa is any aa, unknown, or other
  misc_feature (71)..(71): Xaa is any aa, unknown, or other
  misc_feature (109)..(109): Xaa is any aa, unknown, or other
  misc_feature (110)..(110): Xaa is any aa, unknown, or other
MASLKNHCAVVAAVVVAICFVVLAAXLPSHASTAVDEPAKYKPSRAPAPSPASASSSYVPPPVQPVIVVXXVIYCKSCKLRGYNSGMDASPLPNATASLVCYGDAESKXXVLNQTSTATDTNGYFIVMVYDVGMFDPR

SEQ ID NO: 39984 - DNA, 661 bp, Zea mays
  misc_feature: Ceres CLONE 1431500-F
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
ctggagctccccgcggtggcggccgctctagaactagtggatcccccgggctgcaggaattcgcacgagaccattacctagaacatcctaatcgaaaaattcctctcctcttctctccccgcgcccctccctctcccccaaaaccctaacccatcgtcgaccggtccccgctctcgtggcgccggcaagatgaccctcctcgcagccatcaccaaccccgccgccgactcccgctccggctccagcgagagggctcaccctatcgtgctcaccccgggtgtcacgccgccgccgccgccatcctccacgcttcccaccccaataccgtcttccacctggtcgctctccccagnnnnccccaccctcgccaccgccgcttcctacctcgcggcctcgcttgcctcctgctcctccctcccgcagctccgcgcccttctcaccacctttatnnncactctgtcacaatccctcgcactcccaaccccgccggcggccctccccgccgccatccgcgctgtcgccccttacttccccgccgnnntcgcctcccttgtggcctccaaggcggtaagcctcgccgggcacgacatcctccttgctctcgcggaatcccgcctcctcccgcacccgccnnnnaaagtggggtcgtcgggcggcgagg

SEQ ID NO: 39985 - DNA, 650 bp, Zea mays
  misc_feature: Ceres CLONE 1431501-F
  misc_feature: Encodes the peptide sequence at SEQ ID NO. 39986
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (536)..(536): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
tccccgcggtggcggccgctctagaactagtggatcccccgggctgcaggaattcgcacgagaccattacctagaacatcctaatcgaaaaatgctctcactcccactcccgtccctaccaccccgctccccgccatggcagcactcctcctcctcccgctcgtcctcgccgccagcctaggcttgggcaatgccgacccggctccggccaccatcgtgcacaaggacggcacgacctgcaccctctgcgcgtcgtgcgacaacccctgcaacccgtcctactactacccgccgccgtcccctcccccggcgccggtcaccacgccctgcccgcccaccacgccgnnnnacccttccccctccggcggaggcggaggaggcggaggccccgtcatctactcgtccccgccacctcctgctgcttccggcggcggcggccttnnnagcggaggcttctactacccgccgcccaccggcggaggcggcggcagtggcggtggcgcgtcccaacagggcggtggtgaggaagnnnaggnggcgccgccgccgcccaacccgttcctgccctacttccccttctacttctacagcccgccgccgccgttgcactccggcgcgcggggnnnaaacaaacaaaatgaaaaaaaaaa

SEQ ID NO: 39986 - protein, 171 aa, Zea mays
  misc_feature: Ceres CLONE 1431501-F
  misc_feature (71)..(71): Xaa is any aa, unknown, or other
  misc_feature (72)..(72): Xaa is any aa, unknown, or other
  misc_feature (103)..(103): Xaa is any aa, unknown, or other
  misc_feature (132)..(132): Xaa is any aa, unknown, or other
  misc_feature (133)..(133): Xaa is any aa, unknown, or other
  misc_feature (134)..(134): Xaa is any aa, unknown, or other
  misc_feature (164)..(164): Xaa is any aa, unknown, or other
MAALLLLPLVLAASLGLGNADPAPATIVHKDGTTCTLCASCDNPCNPSYYYPPPSPPPAPVTTPCPPTTPXXPSPSGGGGGGGGPVIYSSPPPPAASGGGGLXSGGFYYPPPTGGGGGSGGGASQQGGGEEXXXAPPPPNPFLPYFPFYFYSPPPPLHSGARGXNKQNEKK

SEQ ID NO: 39987 - DNA, 646 bp, Zea mays
  misc_feature: Ceres CLONE 1431516-F
  misc_feature: Encodes the peptide sequence at SEQ ID NO. 39988
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
ctccccgcggtggcggccgctctagaactagtggatcccccgggctgcaggaattcgcacgagaccatacctagaacatcctaatcgaaaactcaagtcaagtgttcacggtccatcctctcgagagtctaggcccttctcccgaagccgcagacgcagaaaacggctctacatatggaggcgaagaagaagccgtcggcccccgccgccgtcggagccgcgccgccgccgccgggtaacgggtacttcagcaccgtcttctccgcgccgactgcgggaagcgcaagtgannnaaagcatgcggacttgtacacgatgctgaacaagcagagctccagagggcagaatggcagagatggcaaatcccacagccgccctacttacaaggatggcaaacatgctcatccaaatgagccatcagaatctcctnnntttggctcatccgtgcattacggtggtcgggagttctacagcagcgttttacggaagcaaccagccaatgaaccccatacggattacaagggggacaacccggatggctctgctaccagnnntgattggtggcaaggttcactttattactgaataatctgctgggacctctcccttttgtgacaaggaataaaaggggagagctgagaatgtt

SEQ ID NO: 39988 - protein, 136 aa, Zea mays
  misc_feature: Ceres CLONE 1431516-F
  misc_feature (39)..(39): Xaa is any aa, unknown, or other
  misc_feature (40)..(40): Xaa is any aa, unknown, or other
  misc_feature (86)..(86): Xaa is any aa, unknown, or other
  misc_feature (126)..(126): Xaa is any aa, unknown, or other
  misc_feature (127)..(127): Xaa is any aa, unknown, or other
MEAKKKPSAPAAVGAAPPPPGNGYFSTVFSAPTAGSASXXKHADLYTMLNKQSSRGQNGRDGKSHSRPTYKDGKHAHPNEPSESPXFGSSVHYGGREFYSSVLRKQPANEPHTDYKGDNPDGSATXXDWWQGSLYY

SEQ ID NO: 39989 - DNA, 661 bp, Zea mays
  misc_feature: Ceres CLONE 1431527-F
  misc_feature: Encodes the peptide sequence at SEQ ID NO. 39990
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (385)..(385): n is a, c, t, g, unknown, or other
  misc_feature (406)..(406): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (509)..(509): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaactggggctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttnnncatgtgttgctaacgcgaccatttttcctcaatactcacaagctcctatagctngcctttctcccccatactttncatcaatgaccgcttcagtatgtgaaaacccagccctttcaccnnncaggctcaaacagcaatcgcaaacagcaactttactttatcacccctggttcttcancaatcgccagccctattttttggtggcatcatgggtacaaacccatcagggccnnnnacctgcagaacctccgggcttcccggggatcaccccaagttagttttgggaaaaaccttttcccccctaatcttaagaaaaaaaaaaattttttt

SEQ ID NO: 39990 - protein, 107 aa, Zea mays
  misc_feature: Ceres CLONE 1431527-F
  misc_feature (15)..(15): Xaa is any aa, unknown, or other
  misc_feature (16)..(16): Xaa is any aa, unknown, or other
  misc_feature (34)..(34): Xaa is any aa, unknown, or other
  misc_feature (41)..(41): Xaa is any aa, unknown, or other
  misc_feature (56)..(56): Xaa is any aa, unknown, or other
  misc_feature (75)..(75): Xaa is any aa, unknown, or other
  misc_feature (93)..(93): Xaa is any aa, unknown, or other
  misc_feature (94)..(94): Xaa is any aa, unknown, or other
MAAKIFSILMLLALXXCVANATIFPQYSQAPIAXLSPPYFXSMTASVCENPALSPXRLKQQSQTATLLYHPWFFXNRQPYFLVASWVQTHQGXXPAEPPGFPGITPS

SEQ ID NO: 39991 - DNA, 686 bp, Zea mays
  misc_feature: Ceres CLONE 1431535-F
  misc_feature: Encodes the peptide sequence at SEQ ID NO. 39992
aagctggagctccccgcggtggcggccgctctagatctagtggatcccccgggctgcaggaattcgcacgagaccattacctagaacatcctaatcgaaaaaaccctagcgctcccgactctccgcggatcgatggctatggacgcggagcggcggaaggcggacctgatcgcgcagttctctgctcaggcggcggcgctttcgtccgcgccccagctcgtcgcgctggtgcttgagggcacctcccagccggccctcttcgccttctccgagctcctcaccctcccggccctctccaagctcattggaacgcatcacgcgtcgtcactggacttgctccggctcttcgcctacggtaccctgactgactacaacagaaatgcaggattccttcagacactgttgcctgaccagttcccaacgctgcaccagctcagggggctaactctgccacatgcaactggaatactaccttatgatccgctcctgaccgatttagacgtttcaactgtaacagaactcccagatttgctaatcactgagagcatctcctcgggtctctttagaagcggacggcaccaactgagaaggcgctctgagggccaatttgcgactggaggagtccttgcccctggtccctctaaggaccgggccaaaagcccttgcccggatttgatgggggccac

SEQ ID NO: 39992 - protein, 184 aa, Zea mays
  misc_feature: Ceres CLONE 1431535-F
MAMDAERRKADLIAQFSAQAAALSSAPQLVALVLEGTSQPALFAFSELLTLPALSKLIGTHHASSLDLLRLFAYGTLTDYNRNAGFLQTLLPDQFPTLHQLRGLTLPHATGILPYDPLLTDLDVSTVTELPDLLITESISSGLFRSGRHQLRRRSEGQFATGGVLAPGPSKDRAKSPCPDLMGA

SEQ ID NO: 39993 - DNA, 702 bp, Zea mays
  misc_feature: Ceres CLONE 1431538-F
  misc_feature: Encodes the peptide sequence at SEQ ID NO. 39994
  misc_feature (413)..(413): n is a, c, t, g, unknown, or other
  misc_feature (702)..(702): n is a, c, t, g, unknown, or other
ataagctggagctccccgcggtggcggccgctctagaactagtggatcccccgggctgcaggaattcgcacgagaccattacctagaacatcctaatcgaaaattcaccttggctgcagcctgcaacacaatcctacgcttccgacttcaacgcgcgcccctcccattttcacctagccctactcctttgtacataaaggaagatgggagcatatgcaacgactggtatgcagatgatagcaacacgcccttccatcccggcctacaggcaaatacttgggtcgacatcagcactatctgcatttggaaggtcaatctgttccagaactggctttgccatctcttctaaagccacatcagcaggaccactggtttcttcaaattgcaagagggttgttgtgagggcaatgtcncagagaggtgcccaaggacttcccattgatctcacaggaaaaagagcatttatagctggagttgctgatgataatggttatggttgggcaattgctaagggtcttgctgctgctggggctgagattcttgttggaacatgggtgcctgcgttgaacatatttgaaacaagcttgaaaacgggaaaggttgaatgaatccacggaagctccctgaatggatccctttagggagattgctaaaagtattcccccgggaccgcaatttatgaacccccctgaaggatgttcn

SEQ ID NO: 39994 - protein, 134 aa, Zea mays
  misc_feature: Ceres CLONE 1431538-F
  misc_feature: SWISSPROT Homolog: EC 1.3.1.9 Enoyl-[acyl-carrier-protein] reductase (NADH)
MGAYATTGMQMIATRPSIPAYRQILGSTSALSAFGRSICSRTGFAISSKATSAGPLVSSNCKRVVVRAMSQRGAQGLPIDLTGKRAFIAGVADDNGYGWAIAKGLAAAGAEILVGTWVPALNIFETSLKTGKVE

SEQ ID NO: 39995 - DNA, 659 bp, Zea mays
  misc_feature: Ceres CLONE 1431552-F
  misc_feature: Translation starting site: 283
  misc_feature: Pfam Name: MinE Pfam Description: Septum formation topological specificity factor MinE
aaagctggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccataggctgcctaaaaggtatggttcctacaccacgcacaaaacgtgggttttcacaaccatctgaaattacgggggaaaataatcttttctgcaccagcccgatacgacacctcccatgcaaaaatcgcaaaaaacatgcttcagaggaccctgttctccaaaaggggtttacccctgggagcaacgaaaaaaaaacattggcgaaaaactccatgaaggcatgctccgagtttgccccaaaaaaaaacaaggattaccgcccaatggaaaaact

SEQ ID NO: 39996 - DNA, 723 bp, Zea mays
  misc_feature: Ceres CLONE 1431555-F
  misc_feature: Encodes the peptide sequence at SEQ ID NO. 39997
  misc_feature (684)..(684): n is a, c, t, g, unknown, or other
  misc_feature (713)..(713): n is a, c, t, g, unknown, or other
agagctggagctccaccgcggtggcggccgctctagatactagtggatcccccgggctgcaggaattcgcacgagaccattacctagaacatcctaatcgaaaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccggaagcaacaacaagttcacctacaactgggacggtcacactttcaattacctcatggaagacggattcacatactgtgttgttgctgttgaatcggtggggcaacaaattcccttttgctttcatggataggggtaaaggaggatttcccaaaaagggattggtggtgggaaaaagctgctactggctgcagctaaacggcgctcaaatccgaaaggttggggatccaaaacttaaaagaaccacctgcaagaattggtggggggatcccccccttggaaaaagggttagccaaggccttgcccaaaggtggaagggcgccccggggtttncaaagaagcccacaagggggggttcaaancgaaggggac

SEQ ID NO: 39997 - protein, 83 aa, Zea mays
  misc_feature: Ceres CLONE 1431555-F
MGQQSLIYAFVARGTVILAEYTEFTGNFTTIASQCLMKLPGSNNKFTYNWDGHTFNYLMEDGFTYCVVAVESVGQQIPFCFHG

SEQ ID NO: 39998 - DNA, 683 bp, Zea mays
  misc_feature: Ceres CLONE 1431556-F
  misc_feature: Encodes the peptide sequence at SEQ ID NO. 39999
tagagctggagctcaccgcggtggcggccgctctagaactatcggatcccccgggctgggagaattctcacgacaccattacctagaacatccctaatcgaaaaagattacgatcacgtccacctggtctggtcccaccacaggagagcgcgagccctagcccgatctatccggcgggaggtacgaaatctcgccggcggcggggtcccgggacacgccccgtcgaatccgccgctcctcgcagtgcaacacgcccggaccacggtgcatttgatccgtcccggccgcctacacgatgtcctagtcgggagcgatggatcttgcttctggcctcgaatggaagaacggaaggggaatgtcaagtatgccggcgatgaatatgagaaagatcccggatactatggtgggaaggaggaagcaacgaagtccgactatactgatattgtcaagaaatactatgatcttgccactagcttctttgagtatggttggggtgaaaccttccactttgctcgcggatggaatgggaaaatgcttacgggaaaccataaagcaactgggggaattttcatagccttgcaacttgggtttgaaaccggcaagggaaggttttcgagtatgcgcccgctgtaatccgttggaccgaccgaaaaagagattgcaattatttaagtccccaacta

SEQ ID NO: 39999 - protein, 98 aa, Zea mays
  misc_feature: Ceres CLONE 1431556-F
  misc_feature: SWISSPROT Homolog: EC 2.1.1.41 Sterol 24-C-methyltransferase
MEERKGNVKYAGDEYEKDPGYYGGKEEATKSDYTDIVKKYYDLATSFFEYGWGETFHFARGWNGKMLTGNHKATGGIFIALQLGFETGKGRFSSMRPL

SEQ ID NO: 40000 - DNA, 679 bp, Zea mays
  misc_feature: Ceres CLONE 1431557-F
  misc_feature: Encodes the peptide sequence at SEQ ID NO. 40001
aagctggagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaatccctgggtggacgatcaacggcacggttgaactcatttcagcaggccaacaccagggtggcatgatcctgattgtcccacaggggaacatgcagtaaggctagggaatgatgctaaccttgggcaaggtggtggacttttaaaaggggttcggaatatgctatcccattcaggggctgccgggaattggcccaactgaaggcacttgaaggtttccgtgctaaggggctggccca

SEQ ID NO: 40001 - protein, 92 aa, Zea mays
  misc_feature: Ceres CLONE 1431557-F
MEADSARKRLALLALLLLAAPVRPASAAPVEDGLLSNGDFETAPSGGFVKSASVAEGASSIPGWTINGTVELISAGQHQGGMILIVPQGNMQ

SEQ ID NO: 40002 - DNA, 669 bp, Zea mays
  misc_feature: Ceres CLONE 1431562-F
  misc_feature (334)..(334): n is a, c, t, g, unknown, or other
  misc_feature (341)..(341): n is a, c, t, g, unknown, or other
  misc_feature (387)..(387): n is a, c, t, g, unknown, or other
  misc_feature (391)..(391): n is a, c, t, g, unknown, or other
  misc_feature (404)..(404): n is a, c, t, g, unknown, or other
  misc_feature (408)..(408): n is a, c, t, g, unknown, or other
aaagctggagctccccgcggtggcggccgctctagaactagtggatcccccgggctgcaggaattcgcacgagaccattacctagaacatcctaatcgaaaactctccagtctccagcctccatcagtccaggtcgatcgcgatcggaggccagaaatccatggccgctcccgccgccgcgccgctcgacgaagggcaaggcgaagaaagtccttcgccaggtcgagttctacttcagcgacagcaacctcccccgcgataagttccctgcggagacggtcgagcagagcgatgacggattggtgagcttgcccctgatatgctccttctcgcngatgaangtcccacctggggctggacgcaaatgtcaagcctgaaactgtgccngaangagacggtgcttngcgntgctgaggtgctccggccttctcctgccctcgggtatcggaggatggaaaaaaaattgtaaagctaggggactctttaaacccgatgaaatccttaaacaaggaacccctgggactattgcgggaaccccccctgcccttgccaagtgaaaaccggaaaaaccccccatttctttttttcccaaattttcgcaaggggaaaaaaagcggggaaacttcccccccccaattttccccccaaaaaaaaaactttctgtggtgg

SEQ ID NO: 40003 - DNA, 678 bp, Zea mays
  misc_feature: Ceres CLONE 1431566-F
  misc_feature: Encodes the peptide sequence at SEQ ID NO. 40004
aaagctggagctccccgcggtggcggccgctctataactagtggatcccccgggctgcaggaattcgcacgagaccattacctagaacatcctaatcgaaaaagaaaaggagagtaacactcggcactgcagaaatcagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggacatcgcgcgcgcgctggcgctggtggccgcggtggcggtacctagcaacgcgtcgggtgggcacgtcaaccctgcggtcacgttcgggctgctcgtgggccgcctcatctccttcgtgcgtgccacgatatactggctcgcgcaaatgctccgaccccttggtcgcgtccttgctgataaagttcgtctccgggggaacgcgtcccgtggggcttcgggctcttcccggggggcccccgaacgggacgcgcctcctgcttgaggccgacctggactttggggctcttgtacgcccagatac

SEQ ID NO: 40004 - protein, 151 aa, Zea mays
  misc_feature: Ceres CLONE 1431566-F
  misc_feature (20)..(152): Pfam Name: MIP Pfam Description: Major intrinsic protein
MLPGRHPARRADATGTGPLLPDATRAVVAEFVATAMFVFAAEGSVYGLWKLYKDTATPGGLLAVDIARALALVAAVAVPSNASGGHVNPAVTFGLLVGRLISFVRATIYWLAQMLRPLGRVLADKVRLRGNASRGASGSSRGAPERDAPPA

SEQ ID NO: 40005 - DNA, 696 bp, Zea mays
  misc_feature: Ceres CLONE 1431567-F
  misc_feature: Encodes the peptide sequence at SEQ ID NO. 40006
  misc_feature (443)..(443): n is a, c, t, g, unknown, or other
ggagctcaccgcggtggcggccgctctagaactagtggatcccccgggctgcaggaattcgcacgagaccattacctagaacatcctaatcgaaaacccgtccctctcccacccttttcagatctgcctgcgagcccccgccacgcacccccatgcccatgcggccatgcccatgaccccccgacgcgaggccactactgccaatggctccctgccgtgaccgagcccatggaggacctcgccccgggggccctcgcactcttcgccgccgtcgctgacttcatagacgactccgctcctgctgccgccggggccgggatgccaccgccggagcccgagtccgcgcccgggagtccctgctccgactgcagcagcggcggcaccgcccgacttcgaggggtttcgccaaactcccctccacgctcgtgctcgaagaccttgtnttcccccggctccgcctccgcctccgccagttcgctccccgcctccgggcccagggccgccaaggagcgttcttcccgctcaactgcgtgcccgcgctgggggactccaactcccttgtggcgcccgacggccccaaaaatggaagaacgcccccccgccgtggctcccaaacctttctttcacacgtcccccttcttgaaaggctcccccgggggaaaccccccccggtcgaaacggctctccaacccggga

SEQ ID NO: 40006 - protein, 156 aa, Zea mays
  misc_feature: Ceres CLONE 1431567-F
  misc_feature (72)..(72): Xaa is any aa, unknown, or other
MEDLAPGALALFAAVADFIDDSAPAAAGAGMPPPEPESAPGSPCSDCSSGGTARLRGVSPNSPPRSCSKTLXSPGSASASASSLPASGPRAAKERSSRSTACPRWGTPTPLWRPTAPKMEERPPAVAPKPFFHTSPFLKGSPGGNPPRSKRLSNPG

SEQ ID NO: 40007 - DNA, 611 bp, Zea mays
  misc_feature: Ceres CLONE 1431569-F
  misc_feature: Translation starting site: 205
  misc_feature (447)..(447): n is a, c, t, g, unknown, or other
  misc_feature (513)..(513): n is a, c, t, g, unknown, or other
aaactggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccngtgttcctgatcttcgccccgtgctggtccccgccgcgctgctcatcgggacggccgtcatggggntcctcacgtcgggggcgctggggctcgggggcctgccctccttaagtgccctcgccaaccgggcgggaggcgttccacgcaccccggactcctggaga

SEQ ID NO: 40008 - DNA, 671 bp, Zea mays
  misc_feature: Ceres CLONE 1431574-F
  misc_feature: Encodes the peptide sequence at SEQ ID NO. 40009
ggagctccccgcggtggcggccgctctagaactagtggatcccccgggctgcaggaattcgcacgagaccattacctagaacatcctaatcgaaaaaacgaagaaccgaatgcccagtcctgaatcacgtcttcacccgtgctcgtgcgctgcgcccatcccttccgcctccacgctccccacgtgcaccgtgcacagcaccacacagccaggtccccatggcggcggcggcggcggttgcgtctgcgacgacggcggaagacgaagcgcgcctgctgcgcctggaggagcaggcggagcacggcggcggcggcgcctgggaatacctctgcctcgcccgccggctccgcgcccgccgccccgctcacgtcctccgcgtcggcctcgccctcctcaacaaaacgctcgcgcgctccggcctttgctcagacagtggacgctctacgagcagggtggccacggcggccatgattgccagcgtctcgatgtggcaaaggactgtatggaagtccttttcaaaacattttcctgggaagcacacgggttgcccggcttaaaaactcgtcggtttaagccaaaaggggattgggcttaaacctaaaagaacctaccccctatccctggaaaaaaatcccatttgcacaaattgcccacaaaggaaaattgcttct

SEQ ID NO: 40009 - protein, 112 aa, Zea mays
  misc_feature: Ceres CLONE 1431574-F
MAAAAAVASATTAEDEARLLRLEEQAEHGGGGAWEYLCLARRLRARRPAHVLRVGLALLNKTLARSGLCSDSGRSTSRVATAAMIASVSMWQRTVWKSFSKHFPGKHTGCPA

SEQ ID NO: 40010 - DNA, 640 bp, Zea mays
  misc_feature: Ceres CLONE 1431577-F
  misc_feature: Encodes the peptide sequence at SEQ ID NO. 40011
  misc_feature (313)..(313): n is a, c, t, g, unknown, or other
  misc_feature (337)..(337): n is a, c, t, g, unknown, or other
  misc_feature (344)..(344): n is a, c, t, g, unknown, or other
  misc_feature (490)..(490): n is a, c, t, g, unknown, or other
ccggcggtgggcggccgcctctagaactagtggatcccccgggctgcaggaattcgcacgagaccattacctagaacatcctaatcgaaaaactgccggctgtccggagtcccgaccaccgtcctcggctccccgccgtgaatccatcatcccgtaatggagacctgcccctcggtgaagaacatcctcttgctggactcggagggaaagcgcgtcgccgtaaagtactacagcgatgactggcctactctatccgcgaagctggccttcgagaagtcggtattttacaaaacccagaaaagcgaatgctggnaacgaagttgagattgtaatgttngacggtncaatttgtgggtatacaagttcatcccagacctgcacttttttggttactggaagagaagaagagaatgagcttattttagcatccagtctttcggggatctcctgatgctgtccaacgacctcctcaaaacttgtttgaccaaangacagccctcgagaattggaaatggatccattggggcctggaaaaattgttgatggaggggtttgatcttgaacccaaaggagaagagtttccctgaaaaggttccttgacctggatttgaagggtgtttcctccgcttgaaccaacttt

SEQ ID NO: 40011 - protein, 55 aa, Zea mays
  misc_feature: Ceres CLONE 1431577-F
  misc_feature (53)..(53): Xaa is any aa, unknown, or other
METCPSVKNILLLDSEGKRVAVKYYSDDWPTLSAKLAFEKSVFYKTQKSECWXRS

SEQ ID NO: 40012 - DNA, 715 bp, Zea mays
  misc_feature: Ceres CLONE 1431578-F
  misc_feature: Encodes the peptide sequence at SEQ ID NO. 40013
ggcggccgctctagaactagtggatcccccgggctgcaggaattcgcacgagaccattacctagaacatcctaatcgaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtccgtgacgaggtccgtgaaggccgggctccctttccccgtcggccgcatcgcgcgctacctcaagaagggccgctacgcgcagcgcgtcggcagcggtgcccccgtctacctcgcggccgtcctgcagtacctcgccgctgaggtcctggagctcgtcggcacccctgcccaggacaacaagaagacgcgcatcgtcccgcgccacgtgctgctggcgatccgcaacgacaaggagctcggcaagctgctgaccggcgtgaccatcgcccacggcggcgtgttgcccaacatcaacccggtcctgctgcccaagaacacggcggacaaggcgtcctgcggcgggagaaaggacgccaagtcgccccaaaaggccgccaagtcccccaagaacgcctagggatttggaggcggatccgaatgttgtcattgagtagcgtggaaacgcgcccaatggggaattgcctggagtaccctccttcccca

SEQ ID NO: 40013 - protein, 159 aa, Zea mays
  misc_feature: Ceres CLONE 1431578-F
  misc_feature (31)..(104): Pfam Name: Histone Pfam Description: Core histone H2A/H2B/H3/H4
MDATGTGAGGKAKKGAAGRKAGGPRKKSVTRSVKAGLPFPVGRIARYLKKGRYAQRVGSGAPVYLAAVLQYLAAEVLELVGTPAQDNKKTRIVPRHVLLAIRNDKELGKLLTGVTIAHGGVLPNINPVLLPKNTADKASCGGRKDAKSPQKAAKSPKNA

SEQ ID NO: 40014 - DNA, 660 bp, Zea mays
  misc_feature: Ceres CLONE 1431579-F
  misc_feature: Encodes the peptide sequence at SEQ ID NO. 40015
  misc_feature (411)..(411): n is a, c, t, g, unknown, or other
  misc_feature (556)..(556): n is a, c, t, g, unknown, or other
  misc_feature (595)..(595): n is a, c, t, g, unknown, or other
ttcccacgagaccattacctagaacatcctaatcgaaaagtctctttttctccgccccgcccgaagccgaggaggagaggggagcagcgagatcgtgcgcacctccgagatctccacgaagctgtggtaacatggggctcaccttcacgaagctcttcagccggctcttctccaagaaagagatgaggatccttatggttggtctcgatgcagctggtaagaccaccatcctctacaagctcaagctcggagaaatcgtgaccaccatccctacaatcgggtttaatggtggagacggttgaaatacaaaaacattagcttcactgtctggggatgtctggaggtcccggaaagattaggcccccgtggaaggattatttcagaaaacccaaggccctaacttttcttttnaaatccatgacaaacttgggttgttaaaccaaggggggggtccccccgggtgggtaaaccggaaaatttagggaagctgttttggttgttttccggaaaaaagaaatcaccccattccctaaaacctcccaaaaaccccaaaaantttggcaatttccctgggccaaccccctggttttcccanaatcttctgctccccccggagaaggttttaaaaggttttttatatgcccccccaacgattttcaa

SEQ ID NO: 40015 - protein, 56 aa, Zea mays
  misc_feature: Ceres CLONE 1431579-F
  misc_feature (5)..(56): Pfam Name: Arf Pfam Description: ADP-ribosylation factor family
MGLTFTKLFSRLFSKKEMRILMVGLDAAGKTTILYKLKLGEIVTTIPTIGFNGGDG

SEQ ID NO: 40016 - DNA, 641 bp, Zea mays
  misc_feature: Ceres CLONE 1431583-F
  misc_feature: Encodes the peptide sequence at SEQ ID NO. 40017
  misc_feature (427)..(427): n is a, c, t, g, unknown, or other
aagctggagctccaccgcggtggcggccgctctagaactagtggatcccccgggctgcaggaattcgcacgagaccattacctagaacatcctaatcgaaaactctcttcttcccgcggtctgctcgttcgatctgtgcagcagatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaaggatgancaccctctttttgggtcctcccccgtaatgaacaagccccacgttgagcaatggatggattttgcccgcaacgaagttgaatccttggggttgcctgggaactttgaattccaaggctgggggaaacctccccttattgttcgcccccccttggggaaaaacctcttttttttcccttttaaaaaaagccccccttggggcgctctcaaaaacc

SEQ ID NO: 40017 - protein, 151 aa, Zea mays
  misc_feature: Ceres CLONE 1431583-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
  misc_feature (80)..(80): Xaa is any aa, unknown, or other
MALVLHSGAGNKNAFKALIAAEYSGIKVELTKDFEMGVSNKTPEFLKMNPLGKVPVLETPDGPVFESNAIARYVARLKDXHPLFGSSPVMNKPHVEQWMDFARNEVESLGLPGNFEFQGWGKPPLIVRPPLGKNLFFFPFKKSPPWGALKN

SEQ ID NO: 40018 - DNA, 718 bp, Zea mays
  misc_feature: Ceres CLONE 1431584-F
  misc_feature: Encodes the peptide sequence at SEQ ID NO. 40019
  misc_feature (718)..(718): n is a, c, t, g, unknown, or other
ggcggccgctctagaactagtggatcccccgggctgcaggaattcgcacgagaccattacctagaacatcctaatcgaaaaaacaaccaggtcgttcagccgcagattagcaggccgcctgcgctcccaagctcctcctttcccctcagcctcccctcctctccggtgtacgtatccgtcgagatggccgccccgctccggcggagcctcccctcccttggccgcgcgcttctcacgccggcgccggcgcggatgctctccgcggaggcctccgatgccctagttgagatcaagcccggggagatcgggatggtctccggcatccctgaggagcatctccgccgtaaggttctaatttattcaccagctaggactgcatcccagcaaggttcaggcaaagtcgggaggtggaaaattaattttttgtcaacccaaaagtgggagaacccgttgatgggatggacatctactggggatccatatgctaatgtcggtgaagcaggacttacgtttgacagtgcagagtcagcaaaggcgtttgccgaaaaacatggatggaattatgtggttcggaaacgccatgcacctcttctgaggcctaaggcctacgctgagaacttcaagtggagaggccctccgaaagcggagcaagcatgagctcgagacatctgtgatgctgacattggcacgatgtctttttcctcctggctcgattttn

SEQ ID NO: 40019 - protein, 157 aa, Zea mays
  misc_feature: Ceres CLONE 1431584-F
  misc_feature (54)..(156): Pfam Name: ETC_C1_NDUFA4 Pfam Description: ETC complex I subunit conserved region
MAAPLRRSLPSLGRALLTPAPARMLSAEASDALVEIKPGEIGMVSGIPEEHLRRKVLIYSPARTASQQGSGKVGRWKINFLSTQKWENPLMGWTSTGDPYANVGEAGLTFDSAESAKAFAEKHGWNYVVRKRHAPLLRPKAYAENFKWRGPPKAEQA

SEQ ID NO: 40020 - DNA, 666 bp, Zea mays
  misc_feature: Ceres CLONE 1431591-F
  misc_feature: Encodes the peptide sequence at SEQ ID NO. 40021
  misc_feature (497)..(497): n is a, c, t, g, unknown, or other
tccccgcggtggcggccgctctagaactagtggatcccccgggctgcaggaattcgcacgagaccattacctagaacatcctaatcgaaaaatcgcatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgcagatgccatgatgatgccagtatgatgccaccgatgacaatgatgccgatgcccgaatatgatgcatcgataatggtgcgactatgatgtcaccaatacgatagctagtatgatgcccacgatgaatgatgcaaaacatggntttcaccaatgaatgatgccaagtatgatgccctcaaccatgacccccaagtagaatgccccccgaaatggaagccaagtatgaaacccccccaagatgatccccaacctggggtccatcaatgaaaaatggcaaacactgagagaccggcccccaaaggttaccttta

SEQ ID NO: 40021 - protein, 101 aa, Zea mays
  misc_feature: Ceres CLONE 1431591-F
MAAKMFALFALLALCATATSATHIPGHLSPLLMPLATMNPWMQYCMKQQGVANLLAWPTLMLQQLLASPLQPCRCHDDASMMPPMTMMPMPEYDASIMVRL

SEQ ID NO: 40022 - DNA, 1011 bp, Zea mays
  misc_feature: Ceres CLONE 1431597-R
tttttgggttcggggcgcccctcgaggtcgacggtatcgataagctttttttttttttttttggaatgtactttcttatttctgggaagccacaaacatcagacaaaaaactttattattgaactataactcataagaaatctaaaagagggcaccaccaatgatgggttgttggtaagaacactgctgggtttgtcaaagctagttggttgaatggcagcaaatgttgcagttgtaaaaaggagccacctttaggcgcagcttgctagtaaaacggcaacaacctgtggttgtatcatgaaagttgcaaggctcactcctgctatctggctgaacggcaatagctgtctgccgctgtcaaataagcaggaaaaaaattaatgctggccagttgggttggtattggaaaaaaagtgcccccagggatatagacactacgttacctgcgccttaaagggtacctccgtttctctgtgtcgcctcttggattagtcgcacaatttccgattgcgagcctagtagttgtgttcattttgggaagaacataccaccggttccggcatttaagtaatcaatgttcatacatttaattagtaaacccgaacgctagaaaattagagttgctaacaaatggtgaagataatgattctaatctgtcaaagccatcaaagaaatacttaccgcaagcatgaaaacgaacttgtgaattcggtgtgggggtgactgtgagtagatgctattctagtctccctctctggttcctctctacctggttctgtaattatttgctttaattctctttgttcttcgcataggctgtactttactaaatgcctaatggttgatgatagactcgatatctgtcattcattttgatccttgtctacttctattaaatatcctttgtacagacgtgtgtcatcaagtgtcgttgtgacatatatattgctagttcgatgcatctgacagaggacaaaagtaagccaaccattatcgaatcagatttaattg

SEQ ID NO: 40023 - DNA, 705 bp, Zea mays
  misc_feature: Ceres CLONE 1431597-F
  misc_feature: SWISSPROT Homolog: EC 1.11.1.11 L-ascorbate peroxidase
agagctggagctccccgcggtggcggccgctctagaactagtggatcccccgggctgcaggaattcgcacgagaccattacctagaacatcctaatcgaaaaatcgaatttattctagccccgtctcctccgatcggaccgccgggccagcaccggggcggatcgtgacgtcattttgcctggtgaaggtctacgccacggtcgaacgaggactacctcagaggacggtcgtacaaggccaagcgcaagctctgcggtctcttcgcttataagaattgccccctgctcatgctcggcctcggatggtactccgcgggttccttcaatgtggccaccaaaaccgggggccccttcggcatatgaacaaccccgcccaggatgctcacggagccaacgccggactggaaattgccactcttgctgctattagcccatcaaggagcagttccccatcctatcctacactgacttctaccaccttgctggattcctgctcttcgaggcaaccggttgatctgatgtccccttccaccccgggaggcatgactagtctgatcctccaccggaaggtcgccttcctgatgccacctgatgttctgatcacctcatgtctgttttctccacacatatgggtttgagcgacccctacattgttgcgctttctggtggtcacaccctgcgaagatgccactgggacgagtcttg

SEQ ID NO: 40024 - DNA, 669 bp, Zea mays
  misc_feature: Ceres CLONE 1431606-F
  misc_feature (257)..(257): n is a, c, t, g, unknown, or other
  misc_feature (263)..(263): n is a, c, t, g, unknown, or other
  misc_feature (264)..(264): n is a, c, t, g, unknown, or other
  misc_feature (286)..(286): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (331)..(331): n is a, c, t, g, unknown, or other
  misc_feature (332)..(332): n is a, c, t, g, unknown, or other
  misc_feature (334)..(334): n is a, c, t, g, unknown, or other
  misc_feature (357)..(357): n is a, c, t, g, unknown, or other
  misc_feature (359)..(359): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (373)..(373): n is a, c, t, g, unknown, or other
  misc_feature (374)..(374): n is a, c, t, g, unknown, or other
  misc_feature (381)..(381): n is a, c, t, g, unknown, or other
  misc_feature (382)..(382): n is a, c, t, g, unknown, or other
  misc_feature (387)..(387): n is a, c, t, g, unknown, or other
  misc_feature (394)..(394): n is a, c, t, g, unknown, or other
  misc_feature (395)..(395): n is a, c, t, g, unknown, or other
  misc_feature (400)..(400): n is a, c, t, g, unknown, or other
  misc_feature (413)..(413): n is a, c, t, g, unknown, or other
  misc_feature (421)..(421): n is a, c, t, g, unknown, or other
  misc_feature (423)..(423): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (436)..(436): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (460)..(460): n is a, c, t, g, unknown, or other
  misc_feature (461)..(461): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (504)..(504): n is a, c, t, g, unknown, or other
  misc_feature (505)..(505): n is a, c, t, g, unknown, or other
  misc_feature (510)..(510): n is a, c, t, g, unknown, or other
  misc_feature (516)..(516): n is a, c, t, g, unknown, or other
  misc_feature (517)..(517): n is a, c, t, g, unknown, or other
  misc_feature (520)..(520): n is a, c, t, g, unknown, or other
  misc_feature (530)..(530): n is a, c, t, g, unknown, or other
  misc_feature (533)..(533): n is a, c, t, g, unknown, or other
  misc_feature (534)..(534): n is a, c, t, g, unknown, or other
  misc_feature (540)..(540): n is a, c, t, g, unknown, or other
  misc_feature (541)..(541): n is a, c, t, g, unknown, or other
  misc_feature (560)..(560): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (580)..(580): n is a, c, t, g, unknown, or other
  misc_feature (581)..(581): n is a, c, t, g, unknown, or other
  misc_feature (583)..(583): n is a, c, t, g, unknown, or other
  misc_feature (585)..(585): n is a, c, t, g, unknown, or other
gttctcacgagaccattacctagaacatcctattcgaaaaggttttagctggctccgttgccaccgccgctactctcggccagtccgaggtcatcggggtccatgagatgggcgccccctaggtgctccggtgggaggaggtggaggtcggggagcccggtgaaggggacatccgcatcaggaccaccgccggcggcgtcaagttcattgacatttactttctgaagggggtgtaggatgcgcccaccaggcctttnaccccnnaaagggaagccgttggcatcgncaccgccgttggnnntgggctcactggggggaacgagggcaatgnngnggagttgccggcggggccccccncncccannnnnaggannaaatccnnttagnggcggcnngcggncccgggcccgccngcgggggntntccccnnntagancccgctgagnnntatgggataganncgcatgttaaagcttttccgtgttnnnagagtttgactaaggnnaatcnaacccnngcnaacgccccgncanncccaannccgaagccggccccttgcnccgggagggannngcccctnngngncgcttgtttccctttctacacgcctccccatctgttggatgttgtttgttcctttctcccccagcgcacactccgccgcgacac

SEQ ID NO: 40025 - DNA, 726 bp, Zea mays
  misc_feature: Ceres CLONE 1431615-F
  misc_feature: Encodes the peptide sequence at SEQ ID NO. 40026
  misc_feature (362)..(362): n is a, c, t, g, unknown, or other
  misc_feature (363)..(363): n is a, c, t, g, unknown, or other
  misc_feature (385)..(385): n is a, c, t, g, unknown, or other
  misc_feature (390)..(390): n is a, c, t, g, unknown, or other
  misc_feature (393)..(393): n is a, c, t, g, unknown, or other
  misc_feature (476)..(476): n is a, c, t, g, unknown, or other
ccgcggtggcggccgctctagaactagtggatcccccgggctgcaggaattcgcacgagaccattacctagttcatcctaatcgaaaaatccgtgctttgtgcctgtttggtgcgcgtccacctttcggggtcaccggcttctgctttcttgctacgccaccgcgcctctcgtctatttatggagtcccccgatccatgaagccggtgcaggccgagagttgtcaacgacgacgtctgccggcagtgctcctgctcctcctcctccttcccggccgccgcgcgagcttgggttagtgtctcttcttcgcggaggcctgtgagaggagccatcatcatggccgctgttgagactgttgtcctnncaggtgctatgtcatgcgaggnctgcnccngggcgttcagaaaattgctctcccagatgaaagggagtgaaacttccgaaatagaccttcaggagcaaagggtgaccgtcaanggcaatgtcagccttgaggacttccttccaaagggtttccagatcccggaaaaagaacctccaactgggaaggggaaacccccgggccccggaagttggggaaaaaacccccaaaaatcctcccccccaaagggagacccgggtttgtccccctttttttttcctccccccgggggggggggtgtggggggcgccctccccaacctttttaaaaaaaaaaaggggggggaaagatttttctcccctccct

SEQ ID NO: 40026 - protein, 130 aa, Zea mays
  misc_feature: Ceres CLONE 1431615-F
  misc_feature (10)..(10): Xaa is any aa, unknown, or other
  misc_feature (17)..(17): Xaa is any aa, unknown, or other
  misc_feature (19)..(19): Xaa is any aa, unknown, or other
  misc_feature (20)..(20): Xaa is any aa, unknown, or other
  misc_feature (47)..(47): Xaa is any aa, unknown, or other
MAAVETVVLXGAMSCEXCXXAFRKLLSQMKGSETSEIDLQEQRVTVXGNVSLEDFLPKGFQIPEKEPPTGKGKPPGPGSWGKNPQKSSPPKGDPGLSPFFFPPPGGGGVGGALPNLFKKKKGGERFFSPP

SEQ ID NO: 40027 - DNA, 784 bp, Zea mays
  misc_feature: Ceres CLONE 1431626-F
  misc_feature: Encodes the peptide sequence at SEQ ID NO. 40028
gtgtgcggccgcttactttccctggtcggtgtggcgtggcccgcccccctaaaagcggggggcgccgggggggggcgggacctaaggtgggggatacccccggtgcggggtgctggcgggagcattacctatagaagcctaatccagaaactcctgtttgttgaagttggaggtcgaggctggcgtctcccatcatccacgccgagattccaagctcgaaaagcagaccagaaccggttgatgcgtcagtagccgagggcgccggcgatggagaagggcaagggcctcgcccgccgctgggcagtgcagctccacgaggcatcttcctcctcatcctcacctgccttccccgatcctcccggcttcaccagatctgccccggaagcggatgacgccgccggcgcacggcagcgcaaggagaccgaagccgcctgcaaggggcagaagggctgggaggtggcccacccccccttcaagaacctgatgatgatgggttttatgatgtggatggccgggagcacagtccacctgttcatcattggcatcgtcttctctgctctctggcagccgttcaaccgcactccgatctgtcgggaaagtttttgaagcgtttaagggacccacgggtggatacacttgcacccaagttgctcttcactgcctctcaacttggccgctaaggggtttgggtgtttggaaagctcaatactttgggtgcttcttccagacagatggctccaaactggggtgatctttccctgtcgtccaggcgcgggaagggtta

SEQ ID NO: 40028 - protein, 112 aa, Zea mays
  misc_feature: Ceres CLONE 1431626-F
  misc_feature (18)..(113): Pfam Name: DUF1077 Pfam Description: Protein of unknown function (DUF1077)
MEKGKGLARRWAVQLHEASSSSSSPAFPDPPGFTRSAPEADDAAGARQRKETEAACKGQKGWEVAHPPFKNLMMMGFMMWMAGSTVHLFIIGIVFSALWQPFNRTPICRESF

SEQ ID NO: 40029 - DNA, 701 bp, Zea mays
  misc_feature: Ceres CLONE 1431629-F
  misc_feature: Encodes the peptide sequence at SEQ ID NO. 40030
  misc_feature (476)..(476): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (548)..(548): n is a, c, t, g, unknown, or other
  misc_feature (614)..(614): n is a, c, t, g, unknown, or other
  misc_feature (666)..(666): n is a, c, t, g, unknown, or other
  misc_feature (667)..(667): n is a, c, t, g, unknown, or other
  misc_feature (675)..(675): n is a, c, t, g, unknown, or other
gctcttaactagtggatcccccgggctgcaggaattcgcacgagaccattatctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattnggaacaatcctgctctgcggttgattgctgcaattgtatatatnnntgaacatgactacaatgaggctctcnagccacacaccctggaggaactctggatttgcatgcattgaatgtccacatcttcatcaagatgcntcgtacagactaggctgagaaccaataaaagatcatgcaacaaattgatgannaaccaagncttacacaacttggcaacgcctggcc

SEQ ID NO: 40030 - protein, 135 aa, Zea mays
  misc_feature: Ceres CLONE 1431629-F
  misc_feature (3)..(136): Pfam Name: Coatomer_E Pfam Description: Coatomer epsilon subunit
  misc_feature (99)..(99): Xaa is any aa, unknown, or other
  misc_feature (113)..(113): Xaa is any aa, unknown, or other
  misc_feature (114)..(114): Xaa is any aa, unknown, or other
  misc_feature (123)..(123): Xaa is any aa, unknown, or other
MASPDLLFNLRNLFYLGAYQAAINNSDVPGLDADAAAERDAIVFRSYIALGSYQLVISEIDSSAATSLQAVKLLALYLTGDKEGAISSLKEWLSDSAIXNNPALRLIAAIVYXXEHDYNEALXPHTLEELWICMH

SEQ ID NO: 40031 - DNA, 680 bp, Zea mays
  misc_feature: Ceres CLONE 1431632-F
  misc_feature: Encodes the peptide sequence at SEQ ID NO. 40032
aaagctggagctccccgcggtggcggccgctctagaactagtggatcccccgggctgcaggaattcgcacgagaccattacctagaacatcataatcgaaaatttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcgtcggcgcggggcgcctcgccgacgccgcctcctccggccgcgcgtcccccgccggcgcagcttttcaactggccgggcgcccaccagccgcagctcttcccgcccggtccgggcgcgttccaccacccgtcggcgcgggcgatgccgccattgttcccaggcggcggcaaggacgagggccacatgttccacattccaccggcacaccatggcagcaagccactgcacatggacgagctccagcaccggcaccagcagacgatgggggccggtggcgaggcgcccgacggtgaactccggtggcccaacgggctgtccttcttcaccgcgctcaccgggcgagacgacgacgcgaagctgctattcggtggccccggcgccgcg

SEQ ID NO: 40032 - protein, 149 aa, Zea mays
  misc_feature: Ceres CLONE 1431632-F
MRHTFESLGYQSGFFLSQLFSSARGASPTPPPPAARPPPAQLFNWPGAHQPQLFPPGPGAFHHPSARAMPPLFPGGGKDEGHMFHIPPAHHGSKPLHMDELQHRHQQTMGAGGEAPDGELRWPNGLSFFTALTGRDDDAKLLFGGPGAA

SEQ ID NO: 40033 - DNA, 719 bp, Zea mays
  misc_feature: Ceres CLONE 1431645-F
  misc_feature: Translation starting site: 354
  misc_feature: SWISSPROT Homolog: EC 1.15.1.1 Superoxide dismutase
  misc_feature (591)..(591): n is a, c, t, g, unknown, or other
  misc_feature (719)..(719): n is a, c, t, g, unknown, or other
ctccccgcggtggcggccgctctagaactagtggatcccccgggctgcaggaattcgcacgagaccattacctagaacatcctaatcgaaaaactctgatgttgttgcttcgtataacctggtctccgaaatccgaataccccgtagcagctgcggttggatctcagatcggtgctgcggtccctcttttaatttgtttcccctccacttccgttagcgccgactgatcgtcgagtcagatcttacaccctatatatagtctcatctagccgtcactagtgagactcgatttgattcgttccactggattaagcgctttgagcgcgctagatacgtgtcatatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatngctggtgatcttggaaacgtgacagctggagcagatggtgttgctaatatcaatgtcaccgacagccagatcccactgactgggccaaactcaatcattggcagaagctgttgttgttcacgctgatn

SEQ ID NO: 40034 - DNA, 777 bp, Zea mays
  misc_feature: Ceres CLONE 1431646-F
  misc_feature (199)..(199): n is a, c, t, g, unknown, or other
  misc_feature (440)..(440): n is a, c, t, g, unknown, or other
  misc_feature (546)..(546): n is a, c, t, g, unknown, or other
  misc_feature (708)..(708): n is a, c, t, g, unknown, or other
  misc_feature (714)..(714): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
aaagctggagctccccgcggtggcggccgctctagaactagtggatcccccgggctgcaggaattcgcacgagaccattacctagaacatcctaatcgaaaaacactcccatccagccgccaccaggtgcagagtctttcgtcatctcttctccggcgaagaacccccagtcgcccaccagatcacttgtttaactttngtgaggggtgatggcggtttcttttcgcaacctcactccgaggcagggcttaaaagcttgatgagtacttctcactccaagttactcattgggtaacaagcttcaagggtgacttggctgccaaccttcgttttccgcggccccccccccatattttcacggaacgggggggttaacccaatttagccccccgggggggagaggaatttttcaaaagcccgggggggaaatttaacccccnttttttcttccccccccctctattgtttaaaaacccccccccttgttgagaaaaaaaaaaatttttttttttttttgtgggagaaaaaaaaaaaaaaaaagggggnggccctccctctccctcctttcccacaaaaaaaaaaaaagcccctcttttttttttttttttttagagaagaaaaaaaaaaaccccccccccccccttattttttgggggggggggagggcggggcgccccccccccccccctttttttaataaaaaaaagnaaaaancccnnnnnnntccacccttttttttttttttctttgtttgtgggggggggagagagaaaagaa

SEQ ID NO: 40035 - DNA, 646 bp, Zea mays
  misc_feature: Ceres CLONE 1431647-F
  misc_feature: Encodes the peptide sequence at SEQ ID NO. 40036
  misc_feature (276)..(276): n is a, c, t, g, unknown, or other
  misc_feature (289)..(289): n is a, c, t, g, unknown, or other
  misc_feature (293)..(293): n is a, c, t, g, unknown, or other
  misc_feature (294)..(294): n is a, c, t, g, unknown, or other
  misc_feature (331)..(331): n is a, c, t, g, unknown, or other
  misc_feature (332)..(332): n is a, c, t, g, unknown, or other
  misc_feature (339)..(339): n is a, c, t, g, unknown, or other
  misc_feature (511)..(511): n is a, c, t, g, unknown, or other
acccgcggtggcggccgctctagaactagtggatcccccgggctgcaggaattcgcacgagaccattacctagaacatcctaatcgaaaaactcctgtttgttgaagttggaggtcgaggctgccgtctcccatcatccacgccgagagtccaagctccaaaaccaaaccagaaccggttgatccgtcagtagccgcggccgccggcgatggagaagggcaagggcctcgcccgccgctgggcagtggagctccacgacgcatcttcctcctcatncctcgctgccttncccnngatctccggctttcacagatctgccccggaaagcganngacgcgncagcgcacggcagcgcaaggagaccgaagccgcctggaaggggcaaaaggcctgggaaggtggcgcaggccgccctcaagaacctgatgatgatgggttttatgaaggggaatggcccggaacccattccacctgttcaagcattggaatcgtctttcctgggctttggganagcctttaaaggcattccgaatttggggggaaaagtttttggaacctttttaggggcccgggggggggaacacctgggccccaaagttgggctttcccggggccccaaattgggccccttttgggttttgggtgg

SEQ ID NO: 40036 - protein, 103 aa, Zea mays
  misc_feature: Ceres CLONE 1431647-F
  misc_feature (23)..(23): Xaa is any aa, unknown, or other
  misc_feature (27)..(27): Xaa is any aa, unknown, or other
  misc_feature (29)..(29): Xaa is any aa, unknown, or other
  misc_feature (41)..(41): Xaa is any aa, unknown, or other
  misc_feature (42)..(42): Xaa is any aa, unknown, or other
  misc_feature (44)..(44): Xaa is any aa, unknown, or other
  misc_feature (101)..(101): Xaa is any aa, unknown, or other
MEKGKGLARRWAVELHDASSSSXLAAXPXISGFHRSAPESXXRXSARQRKETEAAWKGQKAWEGGAGRPQEPDDDGFYEGEWPGTHSTCSSIGIVFPGLWXSL

SEQ ID NO: 40037 - DNA, 696 bp, Zea mays
  misc_feature: Ceres CLONE 1431653-F
  misc_feature: Encodes the peptide sequence at SEQ ID NO. 40038
ggcggccgctctattttagtggatcccccgggctgcaggaattcgcacgagaccattacctagaacatcctaatcgaaaaactcaacacgcacgggccaggcccagctcagaggcaaaaacccacaccacacttcgttccccttgtcccaattgctcctccacttcccccaccgcccaccagtgatctcgccgccgcgacgcgaggcaccacggccggcgccggccgccttcctccagaaagtatcccccgtgcgcccgaatcacctcttaatttcgttcttagccgctgcgtttcacagaggtcgcgacatgcccgcctcggcggctcctcctgcccagcccgaggcaccgccccctcctcctcctcccgcttctcctgcccctccggaggatgtggaggcaactgccggttcaccttcgagggcttcagcagtggggacggtgaactggggaacggccaccctcgttggcgtcttcgctgggctgctatacggggggagcagggaggcctccgcttccgtcagtaaggatgccgaggtgatgctgaagatgggaagcacaactgacaagcgtgaacagtatagattgatgagagatgctatggagaaaaggttcattcgggttgccaaaggttcactagtcggggggtgttcggctggggatgtttactgcgactttcttggcatacagaaccg

SEQ ID NO: 40038 - protein, 128 aa, Zea mays
  misc_feature: Ceres CLONE 1431653-F
MPASAAPPAQPEAPPPPPPPASPAPPEDVEATAGSPSRASAVGTVNWGTATLVGVFAGLLYGGSREASASVSKDAEVMLKMGSTTDKREQYRLMRDAMEKRFIRVAKGSLVGGCSAGDVYCDFLGIQN

SEQ ID NO: 40039 - DNA, 712 bp, Zea mays
  misc_feature: Ceres CLONE 1431654-F
  misc_feature: Translation starting site: 333
aaagctggagctccccgcggtggcggccgctctagaactagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcgagaaatcgggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttaggttgggggccactgaaataatcgctagtgtcaaggctgaattaggaaaaccaagcattcttcaccctgacaaaggaaaagttgccatttttgtcgactgtagtccaaccgctgagcctctgtttgagggtagaggctctgaagaattgtctgctgagctctctgtttccctgcaaagatgcttgttgggtggtaaaagtggtgctggtgctgcaattgatctgtcatccct

SEQ ID NO: 40040 - DNA, 683 bp, Zea mays
  misc_feature: Ceres CLONE 1431660-F
  misc_feature: Encodes the peptide sequence at SEQ ID NO. 40041
  misc_feature (654)..(654): n is a, c, t, g, unknown, or other
gctctagaactagtggatcccccgggctgcaggaattcgcacgagaccattacctagaacatcctaatcgaaaactgcccctcctccgccgtttcgcctctctccactttccccgtccttcgccgtcgcggccgcgtcctagtctagtctgatggccagccgctgggtccgacccgaggtgtacccgctgttcgcggcgatgggagttgccgttggcatctgcgggtttcagctcttccggaacatcaccggcaacccggaagtcagggtaaacaaggcagggagggcagccggcgtgcttgagaaccatgaggaggggaggcgttacgccatgcatggcctcagaagctttgtgcacgacaagacccccgagatcatgccagctatcaacaagttctttactgaccccaagtgaagcaaagcagctttggttggccgctgatgacgatggttctgctactagttgcccttggggattgtgtaccctttttatggcaattcgatatgtgaatgagttcgacggtccctgtttgttcctcgtactcacctgtcatgtggatttgatgcacttaagtgataaaactgtcagccaacgttcattacaagtggatttttgcaaactggttatgtaaaggggatagtatttgtatttancagtgttttagactttggtctttatgctg

SEQ ID NO: 40041 - protein, 87 aa, Zea mays
  misc_feature: Ceres CLONE 1431660-F
  misc_feature (2)..(88): Pfam Name: B12D Pfam Description: B12D protein
MASRWVRPEVYPLFAAMGVAVGICGFQLFRNITGNPEVRVNKAGRAAGVLENHEEGRRYAMHGLRSFVHDKTPEIMPAINKFFTDPK

SEQ ID NO: 40042 - DNA, 798 bp, Zea mays
  misc_feature: Ceres CLONE 1431661-F
  misc_feature: Encodes the peptide sequence at SEQ ID NO. 40043
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (798)..(798): n is a, c, t, g, unknown, or other
attataacctctctgcctccccaacaaatcccccncggcgcatnnntaaagctggagctccaccgcggtggcggccgctctagaactagtggatcccccgggctgcaggaattcgcacgagaccattacctagaacatcctaatcgaaaaaccactcagtctgccagtccagcacaatatcatgaacaagcgtcaggtcgccgcggcggtggctgccctcctggcgctgctagccgcatcatcgacggccggcgccgtgacgttcgacgcgacgaacatggcgtccgatacccccggcgggcagcggttcgaccaggccgtctgcctcgactacgccaagcaggtcctgtccgacgcgtccacgttcatctggaacaccttctaccagtccagccccgccgaccgcaagccctccgacgcgaggaccctcgccttcgaggacatcggcggcgaggccttccccaccgccaactggatccacctcatcgaggagcacgtaggtggctacttccggcgacgtcaagaccgagttcaccggcggtgctgcaccacgatacaacccaagggagacacctgggaccggcaggggcaccccgaacggcggcctaattcaatggcatcgccaactacgtccggcctgaaggccggcgcacgcgccaagtccaccgggtgctgcccgtgccaggggggaccgggtggtaccaaggggttagaacgtcccggacctacgttccctggaactagcggcgaaatcgcttcaggagggggctcccaccccccagactcacaagcaaaaan

SEQ ID NO: 40043 - protein, 205 aa, Zea mays
  misc_feature: Ceres CLONE 1431661-F
  misc_feature (23)..(191): Pfam Name: BSP Pfam Description: Plant Basic Secretory Protein
MNKRQVAAAVAALLALLAASSTAGAVTFDATNMASDTPGGQRFDQAVCLDYAKQVLSDASTFIWNTFYQSSPADRKPSDARTLAFEDIGGEAFPTANWIHLIEEHVGGYFRRRQDRVHRRCCTTIQPKGDTWDRQGHPERRPNSMASPTTSGLKAGARAKSTGCCPCQGGPGGTKGLERPGPTFPGTSGEIASGGGSHPPDSQAK

SEQ ID NO: 40044 - DNA, 720 bp, Zea mays
  misc_feature: Ceres CLONE 1431690-F
  misc_feature: Encodes the peptide sequence at SEQ ID NO. 40045
aagctggagctccccgcggtggcggccgctctagtttagtggatcccccgggctgcaggaattctcacgagaccattacctagagcatcctaatcgaaaactcacacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgaggctgctgctcctgctgatcccgaggagcttcccgcggccgagcagcaggcagccgccgagcccgaggccgctgctcctgctggtgccgaggagcccgcggcggccgatccggccgccgaggctgaggctgctgctcctgctggtcccgaggagactcccgcggccgagcaggaggcagccgccgaggaggaggctgctgctgctcctcctgctggtgccgaggagcccgccgcggccgagccggtcgccgaagcagaggctgctgctcccgaagagctcgccgcggacgagccggaggctcctgctcctgctggtccccaggagccggccgcgaagcgga

SEQ ID NO: 40045 - protein, 157 aa, Zea mays
  misc_feature: Ceres CLONE 1431690-F
MATAEVQTPTVVAAEEAPVVETPPPAVVPEESAPAEAEAEAEAEAAAPADPEELPAAEQQAAAEPEAAAPAGAEEPAAADPAAEAEAAAPAGPEETPAAEQEAAAEEEAAAAPPAGAEEPAAAEPVAEAEAAAPEELAADEPEAPAPAGPQEPAAKR

SEQ ID NO: 40046 - DNA, 769 bp, Zea mays
  misc_feature: Ceres CLONE 1431699-F
  misc_feature: Encodes the peptide sequence at SEQ ID NO. 40047
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
gggcggttctccccccgtcttttgtgggnannnnnnncccctccnnnntcaagctggagctccccgcggtggcggccgctctatactagtggatcccccgggctgcaggaattcgcacgagaccattacctagaacatcctaatcgaaaagcacatattattgagaccaactagcaacatagaaagcacaatagtgtaccaacaatggcagccaaaatattttgcttccttatgctccttggtctttctgcaagtgttgctaccgcaaccattttcccacagtgctcacaagctcctatagcttcccttcttcccccatacctctcaccagcggtgtcttcaatgtgtgaaaacccaattgttcaaccctacaggatccaacaggcaatcgcaacaggcatcttaccattatcgcccttgttcctccaacaaccgtcagccctattacagcagttacctttggtccatttggtggcacaaaacatcagggcacaacaactacaactacttgtgctagcaaaccttgctgcatactctcagcaacatcagtttcttccattcaaccaactggctgcattgaactctgctgcttatttgcaacaacaattaccattcagcgcggtaggttgctgcctacccccagcaattgcgttccattcaaaccaacatagcagcagtggaacctcggctggcttatttaccggcaggcaacaaaactacctaccatttccgccccggctaggagggaaggcgaagcccctggcctgac

SEQ ID NO: 40047 - protein, 187 aa, Zea mays
  misc_feature: Ceres CLONE 1431699-F
MAAKIFCFLMLLGLSASVATATIFPQCSQAPIASLLPPYLSPAVSSMCENPIVQPYRIQQAIATGILPLSPLFLQQPSALLQQLPLVHLVAQNIRAQQLQLLVLANLAAYSQQHQFLPFNQLAALNSAAYLQQQLPFSAVGCCLPPAIAFHSNQHSSSGTSAGLFTGRQQNYLPFPPRLGGKAKPLA

SEQ ID NO: 40048 - DNA, 733 bp, Zea mays
  misc_feature: Ceres CLONE 1431700-F
  misc_feature: Encodes the peptide sequence at SEQ ID NO. 40049
tccccgcggtggcggccgctctagaactagtggatcccccgggctgcaggaattcgcacgagaccattacctagaacatcctaatcgaaaaagtgttctcgactcgaccgccgccgtcccagttcgcttcgcgtcaccgagagctcgtcggcctccgtccccgctagaagcgagagcatggacacccaggtgaagcttgctgttgtggtgaaggttatgggcaggaccgggtccaggggtcaggtgacccaggtcagagtgaagttcttggatgaccagaaccgtctcatcatgaggaacgtcaagggccctgttcgtgagggtgacatcctcaccctgctcgagtctgagcgggaggccaggaggctgctctgaagccctggtggccttggatgtaattctagtaattttgttctatgtttgacaaacttgcgagttccttgcaacatctgctttgagatttactgaccctggattgcatgtttttttttttgttcctgctggaaagtacccttggcagagacatatttatcattggttgtctaaaagaactcaattcaagggcaggaaaaccagaagggttttgctaaatttggaaaagggcgttctaaaagaaatttttgaaaaaaattaaaggccgggttggcaccaattccaaaaaggtttggaaaaatgaggttcaagaccccccctataggggctaatcgcctcccgaattcgtcttggcgccatc

SEQ ID NO: 40049 - protein, 65 aa, Zea mays
  misc_feature: Ceres CLONE 1431700-F
  misc_feature (1)..(65): Pfam Name: Ribosomal_S28e Pfam Description: Ribosomal protein S28e
MDTQVKLAVVVKVMGRTGSRGQVTQVRVKFLDDQNRLIMRNVKGPVREGDILTLLESEREARRLL

SEQ ID NO: 40050 - DNA, 668 bp, Zea mays
  misc_feature: Ceres CLONE 1431701-F
  misc_feature: Encodes the peptide sequence at SEQ ID NO. 40051
ctagatctcgtggatcccccgggctgcaggaattttcacgagaccattacctagaacatcctaatcgaaaaccaagcttaaaccacaacgcaaacaaccaccaaagcaatcgaaaagcaaccctgcaagtgcaggcaaagagagggcgcgaccaaacagatccaatccaatggcgatggcaccgtccgcagcatgcgtcgtctcgttccccgcccgcccggcggcgtccacggccgggccccgcgccgccgcgggcgccggggcggtccacgctttcgcggggtcggcggagggcgccaagtggtgggcgccgctgctggggtggtcggggaaggccgactacctggaggccccggccccggcgccggcgggggcgcaggacgaggcgccccccaggcagttcgtgggggtgatgactgaggagaaggcccgggagctgcgggcgcggatggcgcatacggagtccttccacgacgccatgtaccactccgccatcgcgtcgcgcctcgcacgctcctcctagggttggtgcgcgcgccggcaactcgccggtgggttgcccccccccccctagcccgggctctggtctgggccgcctccgtgtacgtttgggaagatttggaacgtaactggtctgcccgccccccttgttgctacaggcacggggg

SEQ ID NO: 40051 - protein, 117 aa, Zea mays
  misc_feature: Ceres CLONE 1431701-F
MAMAPSAACVVSFPARPAASTAGPRAAAGAGAVHAFAGSAEGAKWWAPLLGWSGKADYLEAPAPAPAGAQDEAPPRQFVGVMTEEKARELRARMAHTESFHDAMYHSAIASRLARSS

SEQ ID NO: 40052 - DNA, 819 bp, Zea mays
  misc_feature: Ceres CLONE 1431703-F
  misc_feature (1)..(1): n is a, c, t, g, unknown, or other
  misc_feature (7)..(7): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (41)..(41): n is a, c, t, g, unknown, or other
ncccccnttttttttnnttnttttggggggaggggggcggnggttcagagtggagctcaccgcggtggcggccgctctttactagtggatcccccgggctgcaggaattcgcacgagaccattacctagaacatcctaatcgaaaaacgaagtctttgtgagtcccgaccgcaggagcggctattctggcgtccgcgacccaatcccgcttggctggtagaagccgtgctcgcccgcccgctcgtttgtgttatatctgtgggagtgtgcgtccgctcccggagccataacctcctcgtcccctcgagaactgtaccatcacgcgccgcctttgattgaccacggactgggggagaggagaacagagggtgaaaggggggaagaaaacgcttcttgttgcctttgagcttcagcggatacgcagggggggggctcgacggcggggaataggattagcggcccccccagacacctgtcttttttcgccgtccgtgctccccggtttccttcggcccggccggaggtctaagtcgagggcgagggagcagtagattgctcacctgggcggcatcagggcttgccctggttgtcggggccggcagatgtgggcgatcgaagcctctaagggggcgcctcccccgctcctgggaaaagaggcggtggggctttgttccggctccaaagtcgaatgcccttgaaacgggggagagggcccccccctccggcgaattttgggcgaagccttccagtgagtctgttcgtgggccgagttctgaatggggaaaaccctctcgccctgggcggggagagcggtaatcc

SEQ ID NO: 40053 - DNA, 717 bp, Zea mays
  misc_feature: Ceres CLONE 1431706-F
  misc_feature: Encodes the peptide sequence at SEQ ID NO. 40054
aagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctcctctgcctcgaggagttccgcgccctgctcttcggctccggggactcgcccgctgctcggcccccgctcgaccgcctcgtcgccgacttctccgaccgcgccgtcaaggcgctcgacctctgcaacgccgtccgcgacggcctcgacctcgtccgccagtggcgcaagcacctcgccatcgccgcagccgtcctcgcct

SEQ ID NO: 40054 - protein, 146 aa, Zea mays
  misc_feature: Ceres CLONE 1431706-F
  misc_feature (1)..(145): Pfam Name: DUF793 Pfam Description: Protein of unknown function (DUF793)
MPATDSSSSSSSSPAAAPLSSIGRSIRSLRRDQNQIHSFPPPPDATDAFQRRAAQLLADLPAADDVLSLAWTRRLLESFLLCLEEFRALLFGSGDSPAARPPLDRLVADFSDRAVKALDLCNAVRDGLDLVRQWRKHLAIAAAVLA

SEQ ID NO: 40055 - DNA, 693 bp, Zea mays
  misc_feature: Ceres CLONE 1431707-F
  misc_feature: Encodes the peptide sequence at SEQ ID NO. 40056
aagctggagctccccgcggtggcggccgctctataactagtggatcccccgggctgcaggaattcgcacgagacctttacctagaacatcctaatcgaaaaatccctcttcctccgcctcccgctcctgccgggggtgaccaaaatggttccaacgaccgccacctgggaccacagaggctccagccacgagagccggcccgagctgacagcgttccaccatcgacgctgggtgtgaaaggtctggcggactccggttacgagtccatcccgtccatcttccgccacacgccggacgcgctctgagcgacatgatttctccggcgcctctgccgtcgtcctctccctccggcgcctccatcccgggggcggacctctctgtgacgcgacgcgaagacctattcaatcaggagagacgcgcctcaagaactgttgggatacatcagtgagctgaaccacgacacgatctatgatcagagggcctgcatgctccccggggcgcgccaatgtcaaccactcccccgtggaggataagcaggctcactaatccccatacctgccacgttgcctgctcttccccaccgacttctacctcttcaaggtcgactgcggaccactggcgcaactcactcttctcgcgatgaggcaccgtaaccctcctccgcggtgaagagcttccgtcaaccactgacga

SEQ ID NO: 40056 - protein, 45 aa, Zea mays
  misc_feature: Ceres CLONE 1431707-F
MISPAPLPSSSPSGASIPGADLSVTRREDLFNQERRASRTVGIHQ

SEQ ID NO: 40057 - DNA, 685 bp, Zea mays
  misc_feature: Ceres CLONE 1431708-F
  misc_feature: Encodes the peptide sequence at SEQ ID NO. 40058
aaagctggagctccccgcggtggcggccgctctagaactagtggatcccccgggctgcaggaattcgcacgagaccattacctagaacatcctaatcgaaaaaccaaagtccaagcaccttcccaaaaaatcccccattttcttcgaggcgaggagagcgtgaaagacagggcaccggcagcgacatatgtcggggcgcggcaagggcggcaaaggtctgggcaagggcggagcaaaccgccaccggaaggtgctccgtgacaacatccagggcatcaccaagcccgccatccagaggctggctcgcaggggcgacgtgaaccgcatttcggggcttatctactaggagacccgcggcgacctcaagatcttcctcgagaacgtcatcggccacgccctcacctacaccgagcacgcacgccgcaagactgttaccgccatggacgtcgtctacgcgctcaagcgccagggcccacccctctacggcttccgaggctaggctggatgcctcttctccttgctgtcgtggatgcctgtttgatgttaggcttacttcgattagttccttgaccgagacgtgtgggactattcttatgaccattcatgaaggtgagtttcaaatgtaacccaatctaatcgttcgaaaaaaaaaaaaaaaaggttatcgataccgacgacctcgagg

SEQ ID NO: 40058 - protein, 52 aa, Zea mays
  misc_feature: Ceres CLONE 1431708-F
MSGRGKGGKGLGKGGANRHRKVLRDNIQGITKPAIQRLARRGDVNRISGLIY

SEQ ID NO: 40059 - DNA, 704 bp, Zea mays
  misc_feature: Ceres CLONE 1431713-F
aagctggagctccccgcggtggcggccgctctagaactagtggatcccccgggctgcaggaattcgcacgagaccattacctagaacatcctaatcgaaaaaaggatactctctctttctttagtcctttccactgcggccatgcacactagtaactcgcttgacctgacagcagaagagagtacaggagaggcacctgtgaatatgcatgggatgattctctcccccaatgtcttgttcgtgtccaaaccgctagatctcgatgcctctcctctccagatagtgcttctctatcctctccgtggctcgcgcttcctccgattctgcctgcaccccctgccttccggccagatattcggactcccccaccggtatcagtacatcatgtgccctctagccctcctgcggaacgttcctccgacgaaactgatctgccggccacgactactgccatcaacttgtcatcgatgcgaaaagctgtaagggaacctgggatctgaatcacttcaattacaaccgaacacccgactgggattctatcatctgctcctgaggccacaccagaaagtggcttgcaaatcacccatagacaactactaacgctgagcctgctctttggtgctcctcgatcattacgtggagctcgtgcatgaaaagatcctctctagcaaagactgcactcctcaatggtcctgctgcgatga

SEQ ID NO: 40060 - DNA, 817 bp, Zea mays
  misc_feature: Ceres CLONE 1431724-F
  misc_feature: Encodes the peptide sequence at SEQ ID NO. 40061
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (532)..(532): n is a, c, t, g, unknown, or other
  misc_feature (555)..(555): n is a, c, t, g, unknown, or other
  misc_feature (556)..(556): n is a, c, t, g, unknown, or other
  misc_feature (666)..(666): n is a, c, t, g, unknown, or other
ggggggggcccnnncnnnnnnnnnnnncnnncnacgannnancntnnnnnnnnnaaaaactggggctccccgcggtggcggccgctctatactagtggatcccccgggctgcaggagattcgcacgagaccattacctagaacatcctaatcgaaaaaatcgagcatcgcagagataggcgtcttcgtactcgcctacctccgcggctcagacctttcccccttctcccaattccctccgtcggccgccgctccatcccgtacgacgacgccatgagggagtgcatttcgatccacatcggccaggccggtatccaggtcggaaacgcctgctgggagctgtactggcttgagggtggcgttcaggctgagggtcagatgcccgggggacaagaccgttggggggaggtgatgatgcttgctacactttgtttggcgccactggggttgggatagcaccgggcggggggggtttctccccccccggaccccgccgtccttctgtcaggagaggggttggggacctcccgggngagggtgaacacgcgtggaacgnnttccccccatggggacccggagggggccgcccccaaacgctctcgccccccggggcgggtgacacccacggggctggcggccaaatggggggaaccgcaggccgcgtgtnacgcatacttggggagagccgcgcgggagtcgctggacaactggcctcgtaggggggggccccgcccgagcggccgatccggcgggcggcgccccggtggggaagtggaaacacggcgcactctaggctcacctcgcgcgccccacgcccg

SEQ ID NO: 40061 - protein, 60 aa, Zea mays
  misc_feature: Ceres CLONE 1431724-F
MRECISIHIGQAGIQVGNACWELYWLEGGVQAEGQMPGGQDRWGEVMMLATLCLAPLGLG

SEQ ID NO: 40062 - DNA, 862 bp, Zea mays
  misc_feature: Ceres CLONE 1431726-F
  misc_feature: Encodes the peptide sequence at SEQ ID NO. 40063
  misc_feature (5)..(5): n is a, c, t, g, unknown, or other
  misc_feature (28)..(28): n is a, c, t, g, unknown, or other
  misc_feature (30)..(30): n is a, c, t, g, unknown, or other
ccccnccgggggggggtttttttttcananacacccccccacaaaactggagctccccgcggtggcggccgctctatataagtggatcccccgggctgcaggaattctctcgagaccattacctagaacatcctaatcgaaaactctctgtcgcatttcccgtcctgtccttcccttacccggcggcttaaaccctagttctcactcccatcgccgcttcagctccgccgcatcagatggagttctggggtctcgaggtcaagcctggttccactgttaagtgtgagcctggatatggatttgtgctgcacctttcccaggcggcccttggggaatcgaagaagagcgactctgcctggatggatgcgaaatttgatgattagaaacttgccattggaaccctcccgtgttgatggtagttgtaccatccagggggatcggggttttagataaggagttgttgttgcccccccccctacaagaaatactagcggacatatcttattgggtgcttggtctgatggcgcgccgtccacggaagattgaatcgggctcttgtggtttcttgaggagggtagtccaaggtaggggggacgccctcctctcgtttcgcgagtaaagtgggacaagacctcccgggtgggtgtacagcggaacaatgtgttgtgaagagggagaggaagacatggcccctgtgaaaaaatcagcgcgcccgggatcctcaattgcctcgcgcacgggtgcgaacggttggtttcatcaaagcgcacgaagccaaacccacaatcctatagctacatgtagggtaacctcacgacgtcagctttcctctttggaacgcgagctgtctctattccttcgc

SEQ ID NO: 40063 - protein, 48 aa, Zea mays
  misc_feature: Ceres CLONE 1431726-F
MEFWGLEVKPGSTVKCEPGYGFVLHLSQAALGESKKSDSAWMDAKFDD

SEQ ID NO: 40064 - DNA, 707 bp, Zea mays
  misc_feature: Ceres CLONE 1431731-F
  misc_feature: Encodes the peptide sequence at SEQ ID NO. 40065
cgcggtggcggccgctctagaactagtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccacgttgctgcagcggggcgctgcggcggcagtaaccgccgtggatgggcggcgcgccatcgcagcgactggggagaacttcgtgtgcgcaacattggactggtggccgccggacaagtgcgactatcccacctgcccctggggccgcgccggcctgctcaacctgaatctctccaacaaggtcctcctcaacgccgtcggaggacaaggtggtgtacaacaccgcggacctcgggcggccgtgccccccggtcacccagaaccctccgagatgcacggcttcccacagggctgccggaccctacccaggggggacgagctccaccccttcttacaaaaaatcggggtttaagaccaccttgggaatggcaccaaggttggccccggggggcttccgccacaacaaaatttggttggggccacacta

SEQ ID NO: 40065 - protein, 136 aa, Zea mays
  misc_feature: Ceres CLONE 1431731-F
MAAAGTQLGRLLVGGLWLLATLLQRGAAAAVTAVDGRRAIAATGENFVCATLDWWPPDKCDYPTCPWGRAGLLNLNLSNKVLLNAVGGQGGVQHRGPRAAVPPGHPEPSEMHGFPQGCRTLPRGDELHPFLQKIGV

SEQ ID NO: 40066 - DNA, 781 bp, Zea mays
  misc_feature: Ceres CLONE 1431732-F
  misc_feature: Encodes the peptide sequence at SEQ ID NO. 40067
  misc_feature (35)..(35): n is a, c, t, g, unknown, or other
  misc_feature (556)..(556): n is a, c, t, g, unknown, or other
tgggggcgggggggaaggggggggggtcacacganggaaaaaaaaaaaaaacaaagtgggactcaccgcggtggcggccgctctagattagtggatccccgggctgcaggaattctcacgagaccattacctagaacatcctaatccaaaagcaccaccaccgtcactcaacacagcacaggcagctcgagagagagagagagagaaagatgtcgtggttcgggcaccaccaccacaaccagccggctcccccgggtcgggccccaaccaggtgtcaaatcttctgccgcgccaaggagaactactgcctggccgtccctacggcgccgtcgtgctggccccggtcaacccaaggacgaccacccgcaccggtacaaggacatgcgcttcaccacccggggtcagggacaagggaagggcatgccgggggtttcgcccctcggtcaagaagggcccacagggggttcggaaaacaagggccccccccctttgtgtaagatcccccgccccgggtccaggggttgggggggccttttaaacaccccgggaaacacanaaaaggaaacccctttgcggggggttgagggtgaacaaaaaaaacgaggggaccttggggccaaaaggggattatcccactgggaaaggcggcgagggggaaaaaaaaaagggggcggagattaaaaaggggggggggccctctcccaagggggggaaaaaaaacggggggggggggggggaaacaagggggggccccaccctctcgcccttgtggggggatggg

SEQ ID NO: 40067 - protein, 95 aa, Zea mays
  misc_feature: Ceres CLONE 1431732-F
MSWFGHHHHNQPAPPGRAPTRCQIFCRAKENYCLAVPTAPSCWPRSTQGRPPAPVQGHALHHPGSGTREGHAGGFAPRSRRAHRGFGKQGPPPFV

SEQ ID NO: 40068 - DNA, 908 bp, Zea mays
  misc_feature: Ceres CLONE 1431747-F
  misc_feature (21)..(21): n is a, c, t, g, unknown, or other
  misc_feature (36)..(36): n is a, c, t, g, unknown, or other
  misc_feature (37)..(37): n is a, c, t, g, unknown, or other
  misc_feature (908)..(908): n is a, c, t, g, unknown, or other
ggggcgccgggggcggggccnacccggcggtggggnnaaaaaaaataaaaatgggactccccgcggtggcggccgctctagattaatgaatcccccgggctgcaggaattgttacgagaccattacctagaacatcctaatcgaaaaacccccacgccccaccccacgaatagaatggcgccggcggcgacttcctcagcctctgcgccctcctccttccactccagtggtaggacatacgggccagggctcggggcccgggcaacggcgcctcccacgcctagggagaagagcgggtcccaacttggcgccccgaatccggcgagcggttttccgggcgggggcggcgcgtgggggggggggccatggacgaggccaaagacgcaaattcatttaatttgttttgagagggcgggggggggtaggggcccggcagggggcgtggggggaccccccccccccgggcgcgcgttgtgtggagttgtgattgtgggccgccgccccccccccctgaccaccgcggggtgtaaccacggaggggcggggggcgtagacagggaagggagcccaccaagcccccgcgggcgtcgcgatgtaatgtgcgcgggggcatggggcgggggggcacttgccatttatgggcacacacccatcgcctcaggggatgataatcaatctgtcagggtgtggcagtctcaacaacggggcgctgggagtggcggaatattggccggccgagctggatggcgagggggaggagggagcagtcaccaaaggagagggtgtggggtggaatccgggtgggggtataatatcatagccggaggcgtgagaagcgggccccaggttgggttggagggagcgggtggacgtgtcgcagttgctccaccagggaggagattgattan

SEQ ID NO: 40069 - DNA, 835 bp, Zea mays
  misc_feature: Ceres CLONE 1431748-F
  misc_feature: Translation starting site: 165
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
nnnnggggtttttttttttnaaaaattctccttnnnnnnnnnnnaaagctggagctccccgcggtggcggccgctctagattagtggatcccccgggctgcaggaattcgttcgagaccattacctaaaacatcctaatcgaaaaattggggcaggatcccgcgatggctcccagctcggtggcgtggaacccgtccgtggcgcccgcgaggccgaggtcgagctcggtgagcgccgcggctgctgccgggtgcgctgcgagcgccggcccgatgtcctccgtccagcaatagaactcggataggtcgagcgccctgagcgctgggcaccccccgaggagcggctcgaaatccgcgcccggcgtcaaggcccggcgggcgctggtgccaccccccgagtttgaagtggcggagggcggaacttaagggcgcgggggggggtgaaataccttgtagtgttttttgaaacccccccccgggtggaagaaccgtgtgtggtaccccccgcgccccacctgcccacctgaaccagccccccctcttgttacgctaacttggtgtcgtgtttccatggaggggggggaccggggtcctccccccccccctccccacaaaaaaaaaaggaaacccgccggtccccggagtggtaagcgcattggggggggggggggcttttttcccccgccgcggtggttggattgcccagcaccaaaaggaaaaaggaagagccctgcgcaccgtcggtaggtatagctgatctcacatcaccgggggggcgccagtagttggcccgcttcatcaccagttgcctgtgcctcgacgactctgccctctgt

SEQ ID NO: 40070 - DNA, 697 bp, Zea mays
  misc_feature: Ceres CLONE 1431751-F
  misc_feature: Encodes the peptide sequence at SEQ ID NO. 40071
  misc_feature (573)..(573): n is a, c, t, g, unknown, or other
aagctggagctccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgcccgtacagatcagcacccacgttaactgncacacgattaatttagtgatgaggcgtcctgtgcgcgtccgggcaaggaatgcatgcatggcgctgggcgagagtataaaataatgctactggtatttaggctatatcgaggtgtgcctgtctc

SEQ ID NO: 40071 - protein, 146 aa, Zea mays
  misc_feature: Ceres CLONE 1431751-F
  misc_feature (32)..(119): Pfam Name: Tryp_alpha_amyl Pfam Description: Protease inhibitor/seed storage/LTP family
  misc_feature (119)..(119): Xaa is any aa, unknown, or other
MAAPKLATLALAVLLAATVVAPPAAVRAAMSCSTVYSTLMPCLPFVQMGGAMPPQPCCGGIRSLLQQANNTPDRRTICGCLKNVANGANGSGTYISRAAALPSKCGVALPVQISTHVNXHTINLVMRRPVRVRARNACMALGESIK

SEQ ID NO: 40072 - DNA, 709 bp, Zea mays
  misc_feature: Ceres CLONE 1431752-F
  misc_feature: Encodes the peptide sequence at SEQ ID NO. 40073
aaagctggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatgccatgaaccggcgagcccccctcggcgatattggcaacctcgtcagcgtccgcccagccgaagggaaacctcagctgcaggagcagatcaat

SEQ ID NO: 40073 - protein, 69 aa, Zea mays
  misc_feature: Ceres CLONE 1431752-F
MPTRNHNAAAAAAPQHHHHNRGGAPALGKSKAVPGRADAMNRRAPLGDIGNLVSVRPAEGKPQLQEQIN

SEQ ID NO: 40074 - DNA, 682 bp, Zea mays
  misc_feature: Ceres CLONE 1431758-F
  misc_feature (433)..(433): n is a, c, t, g, unknown, or other
  misc_feature (434)..(434): n is a, c, t, g, unknown, or other
aaagctggagctccccgcggtggcggccgctctagaactagtggatcccccgggctgcaggaattcgcacgagaccattacctagaacatcctaatcgaaaaatttttttggttggatctagcgtgacggcaaagacggtgtatcgaagggtcgacaatggttacgacgatcggtagtccatagcagcggcgggcgcaacttcgacccggttttcttcccatatatctgtcaaatccttctccggttgccctccatcggcagcaatttccgccatagataccggcgatcgagggcctcggacaacccaatcgacggagcagcgcggcggcaggagagggcaaacccttttcttctcagtactctacttgtctgcgcctggatcccctccgcaggaagataagacatgggtcaagcactcggcttgattcaagnntgatcatcgacagtagccatcaagaaactttttgggaagttgacgaggtcctagaacctggacccacttcttgccatgtgcataggaagcaaattgctggggaactgtcactggcggggcacaacttgatgtccccttcaacaaaaacaaaggaaatgccctccccagggttggggaatctggcaaatcccggcccttcccaaaaggctctgaagccttttcagggtttaaaaccccggggacaaatc

SEQ ID NO: 40075 - DNA, 725 bp, Zea mays
  misc_feature: Ceres CLONE 1431760-F
  misc_feature: Encodes the peptide sequence at SEQ ID NO. 40076
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (606)..(606): n is a, c, t, g, unknown, or other
  misc_feature (650)..(650): n is a, c, t, g, unknown, or other
  misc_feature (716)..(716): n is a, c, t, g, unknown, or other
aagctggagctccccgcggtggcggccgctctagaactagtggatcccccgggctgcaggaattcgcacgagaccattacctagaacatcctaatcgaaaaatcatacctccgaggctccgaccaaaacaccagggtcccagtgctcttggctctaagatggcggcgccggaaccggaggccaagctggaagccgtaaccccatctcggtcccacgagctgccaccggagtccgaatccgacgcccctgcctccaccggcagccaggagctaaagccgtgggagcagcacgccgcggtgatcaacctcccgcgctacgactaccgcgcatcagggtccctcctcctccgttcgcattccggcttcctcatcacgtgccccatcaagcgtgaaaaaagtgcaaccaagggaagccattcccatccttgaagagtaccatgcaaattgctgtgtttctgaacatgcagaaccatgtgatgtgaaaaatgcaattaagaaaagaaaactgtgctcggaggcatcaggaagtttagaagaggcagtaacgaatgggaatagtagcagtgtttcagaatcaaattggaagcacggaaacacnnnnaacccncccccaatccaggaatgacaatgttgacagggcttcaaatctcntcccctgcgaaactatcaagaagtggcttgctctttcttaaaattccctagtggaagccgttcatngtagtggaa

SEQ ID NO: 40076 - protein, 89 aa, Zea mays
  misc_feature: Ceres CLONE 1431760-F
MAAPEPEAKLEAVTPSRSHELPPESESDAPASTGSQELKPWEQHAAVINLPRYDYRASGSLLLRSHSGFLITCPIKREKSATKGSHSHP

SEQ ID NO: 40077 - DNA, 883 bp, Zea mays
  misc_feature: Ceres CLONE 1431762-F
  misc_feature: Encodes the peptide sequence at SEQ ID NO. 40078
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (17)..(17): n is a, c, t, g, unknown, or other
  misc_feature (19)..(19): n is a, c, t, g, unknown, or other
  misc_feature (28)..(28): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (883)..(883): n is a, c, t, g, unknown, or other
naaccccnnnnnntntntnatattcttnncggcccccnnnttaacatgggactccccgcggtggcggccgctctagaatagtggatcccccgggctgcaggaattcgcacgagaccattacctagaacatcctaatcgaaatctataaatggctagctcccacatatgaactagtctctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacaatgatgggcgccggcgggctgtaccccttaccgggagtacttgaggtggccgcagtgccaccggggggggggggggcacccttactacgccgggtgcggcccccccccaccgccatggttccagcacgctctggggaacagtgcctcccctgcgcgcaatgaaggattgaaggacggtggcgctcccggtccccgcacccaccgtggcgaagggaagaatgcctcatttgcagcggtgcccgcctggcctgcccaaaagccgcccggcggataggaaccccagccctgggaagggcagccagcaaactcagtcacgctcgggggggtgggggcccgcggggccctcgcccgcccctgggccgcaggatacgaacggcccgaaaaaaaccatgcgccggcgcctcgcgaaggcgggcgccccacgcctctcgcccgcagagttgctcccaagcctcaactgcgacccgaagcgcccgccgcgagggggagactcgcgcggggggagcggctgtgtn

SEQ ID NO: 40078 - protein, 95 aa, Zea mays
  misc_feature: Ceres CLONE 1431762-F
MKMVIVLVVCLALSAASASAMQMPCPCAGLQGLYGAGAGLTTMMGAGGLYPLPGVLEVAAVPPGGGGAPLLRRVRPPPTAMVPARSGEQCLPCAQ

SEQ ID NO: 40079 - DNA, 735 bp, Zea mays
  misc_feature: Ceres CLONE 1431763-F
  misc_feature: Encodes the peptide sequence at SEQ ID NO. 40080
  misc_feature (735)..(735): n is a, c, t, g, unknown, or other
agctccccgcggtggcggccgctctagaactagtggatcccccgggctgcaggaattcgcacgagaccattacctagaacatcctaatcgaaaaactctctagagtaagtgtgtgagtgactgcgatgggaggagacgggggtgatgagccaataattcactttgtactcgttcatggagcctgccacggtgcttggtgttggtatagactcaccactcttcttctgtccgccggattcaaagccaccaccgtcgacctcaccagtgccggcatcaacctcaccgacgctaacaccgtcttcgagttcgaccattataaccgtcctctcttctctctcctctccgatatccctcatcaccacaagatcatactcgtgggacatagcatcggcggagcaagtgtcaccgcagctctctgcaagttctcagacaaaatctccatggccgtttacctcgttgctgacatggttcaacccggaaccacatctcctcctcattcaataatgtctgtgggagaagaggaagacatatgggagtttacgtataacggaggcgatgagaaaccaccatcggcggcgcaagttacagaagaatatcggcggcttcattgctatgcgcgaagtcgcctctgtgagtgatggtctgcggtctaagctgttgggacacctgtggggggaggctttcggcaacctccctaagggaacctgcacggaattgaagcgggtggggcccgcn

SEQ ID NO: 40080 - protein, 170 aa, Zea mays
  misc_feature: Ceres CLONE 1431763-F
  misc_feature: SWISSPROT Homolog: EC 3.1.1.78 Polyneuridine-aldehyde esterase
MGGDGGDEPIIHFVLVHGACHGAWCWYRLTTLLLSAGFKATTVDLTSAGINLTDANTVFEFDHYNRPLFSLLSDIPHHHKIILVGHSIGGASVTAALCKFSDKISMAVYLVADMVQPGTTSPPHSIMSVGEEEDIWEFTYNGGDEKPPSAAQVTEEYRRLHCYARSRLCE

SEQ ID NO: 40081 - DNA, 737 bp, Zea mays
  misc_feature: Ceres CLONE 1431765-F
  misc_feature: Encodes the peptide sequence at SEQ ID NO. 40082
  misc_feature (366)..(366): n is a, c, t, g, unknown, or other
  misc_feature (400)..(400): n is a, c, t, g, unknown, or other
  misc_feature (425)..(425): n is a, c, t, g, unknown, or other
  misc_feature (435)..(435): n is a, c, t, g, unknown, or other
  misc_feature (459)..(459): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
aagctggagctccccgcggtggcggccgctctagaactagtggatcccccgggctgcaggaattcgcacgagaccatacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcaaacgggaccgcaaggaggacctgcggtggtgcaagcaggcgtgcgagtggcantacggaaaggacacccccgcgaagagggaatgcnagagcgagtgccgcgagcggcacancaagctgacncgggcgaggacggcaacagcggcntggacccctacgtctcccgctccgggaggggcgagtggccgcccccagtgccttgccccgcacgagggccacccgtgggaagactcagaatgcattgaggggtggcccccccccgggaatggcctttccattggaaaaaaaaaatacggtcccggcacccaaagccccgggcaatggcccgggaaagggccaggcccccccccccggggggatgtgggggaaagacacccttccttagaggaaaaaaaannnnnggggggggggggaaaaaaaaaccc

SEQ ID NO: 40082 - protein, 175 aa, Zea mays
  misc_feature: Ceres CLONE 1431765-F
  misc_feature (52)..(52): Xaa is any aa, unknown, or other
  misc_feature (64)..(64): Xaa is any aa, unknown, or other
  misc_feature (72)..(72): Xaa is any aa, unknown, or other
  misc_feature (167)..(167): Xaa is any aa, unknown, or other
  misc_feature (168)..(168): Xaa is any aa, unknown, or other
MGKGSVGASWWAFLLLAGVLLVVAATAGAEDGVVKRDRKEDLRWCKQACEWXYGKDTPAKRECXSECRERHXKLTRARTATAAWTPTSPAPGGASGRPQCLAPHEGHPWEDSECIEGWPPPGNGLSIGKKKYGPGTQSPGQWPGKGPGPPPRGDVGERHPSLEEKKXXGGGGKKN

SEQ ID NO: 40083 - DNA, 671 bp, Zea mays
  misc_feature: Ceres CLONE 1431770-F
  misc_feature: Encodes the peptide sequence at SEQ ID NO. 40084
gctctagatctagtggatcccccgggctgcaggaattcgcacgagaccattacctagaacatcctaatcgaaaaaattgaaaacagggccttggtcgagttaaaaaaaacgcgagtgaaacacactgacaccgcaaacacgccaaccggcctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacgggggagcttccagctccgacgccaaggagaacgccgatcccaaccccgagccacaggttgaggtggagatagagtacgtgccggagaaggccgagcttgacgaccctctcctggatgattttcaaggccatcttcgagaagttcaccttcaaggacgctgctgcagcggcggccgaggatgataataaagacgagggtgccgctgatgccacaaagaaggggtcactggatgatgatgacaaccaccaatatgatgagccgggagcaaacaagaaaaaggacggaggcctatccaataaaaaaaaaagcttggaacgcag

SEQ ID NO: 40084 - protein, 114 aa, Zea mays
  misc_feature: Ceres CLONE 1431770-F
MAAAAEVDPSPNPPPTTASGLSKTKTREADRRRRRRSKAKKNKSVTEADAQDADGGASSSDAKENADPNPEPQVEVEIEYVPEKAELDDPLLDDFQGHLREVHLQGRCCSGGRG

SEQ ID NO: 40085 - DNA, 745 bp, Zea mays
  misc_feature: Ceres CLONE 1431771-F
  misc_feature: Encodes the peptide sequence at SEQ ID NO. 40086
  misc_feature (345)..(345): n is a, c, t, g, unknown, or other
  misc_feature (401)..(401): n is a, c, t, g, unknown, or other
  misc_feature (434)..(434): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaagaatgggcagnccttcatgtgctcgggcggacgggtgtgtccgttccggcgctctgcccgcaagctngtgctgtgcgccagctgctgcttccctacggcngctccagtcccggacggagaggtgcgggtgcttgcctgccgcagcatcttcaccggttgccgaggcgtcaggatttcgtcgcccagggcggggccggtcccattcttaagttggtgggcttcacccaaaagccgaaaaggcggggcttgaaatttttcaggccccggcccccctgggggttccggggtccaaagcggggcccccttaaacccccccgcccccccacccgtaaaatttttcgttggggaaaatttaggttccccaaccggggccggggaaaaaaattcccctttcccccaaaaggggggagg

SEQ ID NO: 40086 - protein, 79 aa, Zea mays
  misc_feature: Ceres CLONE 1431771-F
  misc_feature (14)..(14): Xaa is any aa, unknown, or other
  misc_feature (33)..(33): Xaa is any aa, unknown, or other
  misc_feature (44)..(44): Xaa is any aa, unknown, or other
MLLTSCRQGRRMGXPSCARADGCVRSGALPASXCCAPAAASLRXLQSRTERCGCLPAAASSPVAEASGFRRPGRGRSHS

SEQ ID NO: 40087 - DNA, 755 bp, Zea mays
  misc_feature: Ceres CLONE 1431774-F
  misc_feature: Encodes the peptide sequence at SEQ ID NO. 40088
  misc_feature (412)..(412): n is a, c, t, g, unknown, or other
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaaattcaccttggctgcagcctgcaacacaatcctacgcttccgacttcaacgcgcgcccctcccattttcacctagccctactcctttgtacataaaggaagatgggagcatatgcaacgactggtatgcagatgatagcaacacgcccttccatcccggcctacaggcaaatacttgggtcgacatcagcactatctgcatttggaaggtcaatctgttccagaactggctttgccatctcttctaaagccacatcagcaggaccactggtttcttcaaattgcaagagggttgttgtgagggcaatgtcncaaaanagccgcccagggacttcccattgatctcacaggtaaaaaagcaattttaagctgggagtggctgatgaataatgggtatgggttggccaattgctaaaggctcttggctgccggctgggggctgaaatttcttggttgggacaggggggccctggctttgaacatattttgaaacacaccttggaaacactggaaaggtttgaataaaaccccggaaacctcccctgaagggatctccctaaggggaaatggtttaaagattaccccccgggggccccgtttttaaaaacccccccgggggggttgttcctgagaaaatttttaaaaccaaccaaag

SEQ ID NO: 40088 - protein, 79 aa, Zea mays
  misc_feature: Ceres CLONE 1431774-F
  misc_feature (72)..(72): Xaa is any aa, unknown, or other
MGAYATTGMQMIATRPSIPAYRQILGSTSALSAFGRSICSRTGFAISSKATSAGPLVSSNCKRVVVRAMSQXSRPGTSH

SEQ ID NO: 40089 - DNA, 695 bp, Zea mays
  misc_feature: Ceres CLONE 1431777-F
  misc_feature: Encodes the peptide sequence at SEQ ID NO. 40090
aaagctggagctccccgcggtggcggccgctctagaactagtggatcccccgggctgcaggaattcgcacgagaccattacctagaacatcctaatcgaaaaatctcgtcgctcggctcccgaccgcatcgcgatcagtcatctcctgcgtctcgttctcgccggagatcagacgcgccaccgccgggcgatggatgcctcctaccgccgcgccggtgccggaagcggttctgctccccgctccgtcgaggacatctacaaggactaccgcgcccgccgctccgccgtcctccgcgccctcacccacgacgtcgaggagttctacgcgctgtgcgatccagagaaggagaacctgtgcctatacgggtacgcaaacgaagcgtgggaggtggcgctgccggcggaggaggtgcccacggagctgccggagcctgcgctcgggatcaacttcgcgcgcgacgggatgaaccgtcgcgactggctcgcgctcgtcgccgtccactccgactcgtggctcatatccgtcgcattctactacgccgcgcggctcaaccgaagtgatcgtcgtctccggtggtgtgaagcaatctaaggaaagggacagatccggtactgacaacagtggtagaaataaactgtcagcaaagcaaacaagcgagccacggttagaaaataatgccagggagcctgacgag

SEQ ID NO: 40090 - protein, 133 aa, Zea mays; identical to SEQ ID NO: 36292
  misc_feature: Ceres CLONE 1431777-F

SEQ ID NO: 40091 - DNA, 733 bp, Zea mays
  misc_feature: Ceres CLONE 1431788-F
  misc_feature: Encodes the peptide sequence at SEQ ID NO. 40092
gcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgcgccggggctggccgtggccacgccggtgttcctgatcttcagccccgtgctcgtccccgccgcgctgcttatcgggacggccgtcatgaggttcctcacgtcgggccgcgctggggctcgggggccctgtcttccctcacgtgcctcgccaacacggggcggcaaggctttccagcgcccccccgaactaagtggaggaaggcgccaccccaggaatgggcgaaggcccccgccccacccccggccgacaagaaccccccagggccggcccagcgccatcccaagggcaagggccccaggaaagccccggtctcccgggggaaggt

SEQ ID NO: 40092 - protein, 181 aa, Zea mays
  misc_feature: Ceres CLONE 1431788-F
  misc_feature (44)..(154): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASAPGLAVATPVFLIFSPVLVPAALLIGTAVMRFLTSGRAGARGPCLPSRASPTRGGKAFQRPPELSGGRRHPRNGRRPPPHPRPTRTPQGRPSAIPRARAPGKPRSPGGR

SEQ ID NO: 40093 - DNA, 762 bp, Zea mays
  misc_feature: Ceres CLONE 1431791-F
  misc_feature: Encodes the peptide sequence at SEQ ID NO. 40094
ggcggccgctctagaactagtggatcccccgggctgcaggaattcgcacgagaccattacctagaacatcctaatcgaaaactaatcgagcatcgcagagataggcgtcttcgtactcgcctacctccacggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcaaggagactggggctgggaagcacgtgccccgtgctgtttttgttaaccttgaacccactgtcatcgatggaggtgaggactggcaccctaccgccagcttcttccaccctgaagcgtttcatctgggggaaaggagggatccacccaaccactttggcccgggggaccctaccccgttgggcaaggaaaattggttaacccttgccttgggatgcgcatcaggaaggcttggccgaaaaactgggcccggggccctccagggggcttcccctcgttcttccagcgctggtttgggggagaaggaaacggggcttttcgggccctgggtctccccccccgcgccaaaaaccggaccctgttccttgttgtcactacgcgccaaaagaaaaccctcacgccctggg

SEQ ID NO: 40094 - protein, 188 aa, Zea mays
  misc_feature: Ceres CLONE 1431791-F
MRECISIHIGQAGIQVGNACWELYCLEHGIQADGQMPGDKTIGGGDDAFNTFFKETGAGKHVPRAVFVNLEPTVIDGGEDWHPTASFFHPEAFHLGERRDPPNHFGPGDPTPLGKENWLTLALGCASGRLGRKTGPGALQGASPRSSSAGLGEKETGLFGPWVSPPAPKTGPCSLLSLRAKRKPSRPG

SEQ ID NO: 40095 - DNA, 680 bp, Zea mays
  misc_feature: Ceres CLONE 1431798-F
  misc_feature: Encodes the peptide sequence at SEQ ID NO. 40096
  misc_feature (485)..(485): n is a, c, t, g, unknown, or other
  misc_feature (486)..(486): n is a, c, t, g, unknown, or other
ctccccgcggtggcggccgctctagaactagtggatcccccgggctgcaggaattcgcacgagaccattacctagaacatcctaatcgaaaatgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacnngtgtggccgtggaggcggcggctacggcggtggcgggcgccctgatggcggcggcggcttaccgcgtggcggcggctacagtggtggcgggcgcggctacgggtggtggtggcggcggctacggcggttggcaccgtgggcggcggctaccggcacctcggacggaactgggagaacttaacgggtgggcccct

SEQ ID NO: 40096 - protein, 158 aa, Zea mays
  misc_feature: Ceres CLONE 1431798-F
  misc_feature (10)..(81): Pfam Name: RRM_1 Pfam Description: RNA recognition motif. (a.k.a. RRM, RBD, or RNP domain)
  misc_feature (48)..(129): Pfam Name: GRP Pfam Description: Glycine rich protein family
  misc_feature: SWISSPROT Homolog: EC 5.2.1.8 Peptidylprolyl isomerase
  misc_feature (99)..(99): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGGYXCGRGGGGYGGGGRPDGGGGLPRGGGYSGGGRGYGWWWRRLRRLAPWAAATGTSDGTGRT

SEQ ID NO: 40097 - DNA, 713 bp, Zea mays
  misc_feature: Ceres CLONE 1431799-F
  misc_feature: Encodes the peptide sequence at SEQ ID NO. 40098
ggagctccccgcggtggcggccgctctagaactagtggatcccccgggctgcaggaattcgcacgagaccattacctagaacatcctaatcgaaaagtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcaagtccaacgcagtgcaattcaccctcgagcacgaccttggccaccgcaaggggcttcctctcagctggaaccttctcgggccgccttcaagaccttcgcccacgggaccgcaaaccctcactaaactttccttttccaggaaggatttttccggaggatgaaaaaacgggcgtcaaaaaaagtgctccgggaaaatggtttttatacaattaggccccccctcaagggggtgggacccccccaaaaaacccccgggttgttctccccaaccgaagccagagcgtttccccgggggcatggtggagagaaacccttttgtctcccgggggggggggggaaa

SEQ ID NO: 40098 - protein, 125 aa, Zea mays
  misc_feature: Ceres CLONE 1431799-F
MAPPRRALLVLAALLLSLSLGAASFHSDELLLNDDEEFEGVVARPSAPSPPAAPVVSSSRRRSADAPLPGSGKSNAVQFTLEHDLGHRKGLPLSWNLLGPPSRPSPTGPQTLTKLSFSRKDFSGG

SEQ ID NO: 40099 - DNA, 707 bp, Zea mays
  misc_feature: Ceres CLONE 1431801-F
  misc_feature: Encodes the peptide sequence at SEQ ID NO. 40100
  misc_feature (469)..(469): n is a, c, t, g, unknown, or other
ggagctccccgcggtggcggccgctctagaactagtggatcccccgggctgcaggaattcgcacgagaccattacctagaacatcctaatcgaaaaaattttgcttccggctgccgctcttctccgccgccgccccgatccccttcctccccaagcccttcaactatccactcccgcgtccccggagaagcggcgagatgtacggcatcctgacctccccctgccctcgagccccgcttctccgcgctctcccgagcccatccgcccgcgcattccccagaacactagccttccccgcgaggcccctcccccgcggtctccgcctgacccctccgcacgccgccgcggaggcatcggcggcagccacggcgttgggcgggcttctggcgtcgccgctctcgactctggaggccgccctgcggggcctcaacctcgcgccccttcgcgccccgtggcggcggcaatgtcngcggcccgtgcgtggctggaagtgtaccgggagtgctgctcgtcggcgtgctgctctcctgttcccccacattccctggggaccgcaggcccttctcgccctgggggacctttggaacccttcctcgcctgggccgtgaggcatgccccccggttcggggccagctaaacccaacccccttgtgcttccgggcattgacaccccccaagaacctgcccccaacccccaggttaaagcc

SEQ ID NO: 40100 - protein, 57 aa, Zea mays
  misc_feature: Ceres CLONE 1431801-F
MSAARAWLEVYRECCSSACCSPVPPHSLGTAGPSRPGGPLEPFLAWAVRHAPRFGAS

SEQ ID NO: 40101 - DNA, 737 bp, Zea mays
  misc_feature: Ceres CLONE 1431803-F
  misc_feature: Encodes the peptide sequence at SEQ ID NO. 40102
  misc_feature (407)..(407): n is a, c, t, g, unknown, or other
  misc_feature (434)..(434): n is a, c, t, g, unknown, or other
  misc_feature (493)..(493): n is a, c, t, g, unknown, or other
  misc_feature (531)..(531): n is a, c, t, g, unknown, or other
  misc_feature (539)..(539): n is a, c, t, g, unknown, or other
tccccgcggtggcggccgctctagaactagtggatcccccgggctgcaggaattcgcacgagaccattacctagaacatcctaatccaaaaaaacgggaaaggcacaaggaagaagagagatcaactactcatgcaagcactgcggtatttaatttagattcttaggaacaaaaacaccaagcaccaactttgtacatatgaatggacgccatgcacatggtgatcgatcggtctatatagaaagacaggagggtactagagaagttgtgtggtgtacaagctacacacgggatgatactaattagctgcaggcaagggcgaggaatgccaagcctttcatgtgatcgggcggacggagttgtccgttcgggcgctctgcccgccaagctgtttgtgtgcgccagcngctgcttccctagggcggatccagtcncgcacggagaggggcaggtgcttgcctgccgccagaatctccaccgcttgccgaggggncaggatctccgtggccgggggccgcggcggccccatgnttaggttngtcggcccttcaccaggcagccgcaacagcgccggccttgaaactgctcagagcccttctccaacccgggggtccgggggttccttaacccgggcgcgccttgagccggccgccgcccccgcaccggttggagctttcggactggaaaatagactgccacctaccaaaacgttggcgcgggcaacaaaatttcaagtt

SEQ ID NO: 40102 - protein, 79 aa, Zea mays
  misc_feature: Ceres CLONE 1431803-F
  misc_feature (39)..(39): Xaa is any aa, unknown, or other
  misc_feature (48)..(48): Xaa is any aa, unknown, or other
MILISCRQGRGMPSLSCDRADGVVRSGALPAKLFVCASXCFPRADPVXHGEGQVLACRQNLHRLPRGQDLRGRGPRRPH

SEQ ID NO: 40103 - DNA, 735 bp, Zea mays
  misc_feature: Ceres CLONE 1431808-F
  misc_feature: Encodes the peptide sequence at SEQ ID NO. 40104
ggagctccccgcggtggcggccgctctataactagtggatcccccgggctgcaggaattcgcacgagaccattacctagaacatcctaatcgaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaaacggctctgggcttggttctctcctcctggagcgcctgtctggtgactatggcaagaagtcaagctcggtttcaccgtgta

SEQ ID NO: 40104 - protein, 171 aa, Zea mays
  misc_feature: Ceres CLONE 1431808-F
  misc_feature (49)..(171): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGNGSGLGSLLLERLSGDYGKKSSSVSPC

SEQ ID NO: 40105 - DNA, 701 bp, Zea mays
  misc_feature: Ceres CLONE 1431812-F
  misc_feature: Encodes the peptide sequence at SEQ ID NO. 40106
  misc_feature (357)..(357): n is a, c, t, g, unknown, or other
  misc_feature (701)..(701): n is a, c, t, g, unknown, or other
tcaccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcantacggaaaggacaccccgcggaagagggaatgcgagagcgagtgccgcgagcggcaccagcaagctgacgcgggcgaggacggcaacagcggcgtggacgcctacgtctccccgctccgggaggggcgagtgccggcgccagtgcctgcgccgcacgagggccagccgtgggagacccaggatgcatgaggcggtgcggccgccgcgactgcccgtccacatgaagcaagatacggtccccgcaccaagaacccggcaaatgccgggaaaggtccaccgcccccaccgcgggactggtggaaaggcaccccttcctgatgaactcacaaccccggggcgggagn

SEQ ID NO: 40106 - protein, 114 aa, Zea mays
  misc_feature: Ceres CLONE 1431812-F
  misc_feature (52)..(52): Xaa is any aa, unknown, or other
MGKGSVGASWWAFLLLAGVLLVVAATAGAEDGVVERDRKEDLRWCKQACEWXYGKDTPRKRECESECRERHQQADAGEDGNSGVDAYVSPLREGRVPAPVPAPHEGQPWETQDA

SEQ ID NO: 40107 - DNA, 649 bp, Zea mays
  misc_feature: Ceres CLONE 1431813-F
  misc_feature: Encodes the peptide sequence at SEQ ID NO. 40108
  misc_feature (1)..(1): n is a, c, t, g, unknown, or other
  misc_feature (166)..(166): n is a, c, t, g, unknown, or other
  misc_feature (538)..(538): n is a, c, t, g, unknown, or other
  misc_feature (556)..(556): n is a, c, t, g, unknown, or other
  misc_feature (561)..(561): n is a, c, t, g, unknown, or other
  misc_feature (562)..(562): n is a, c, t, g, unknown, or other
naaagctggagctccccgcggtggcggccgctctagaactagtggatcccccgggctgcaggaattcgcacgagaccattacctagaacatcctaatcgaaaaaccccagccgccgccgccgccaccgccaccgccaccgccacctgccccagcgcgccgccgccngcagccaccatgggtcgcgtccgcaccagaccgtgaagagacctccagcaagtgatcgagagtactactcccgcatgaccctcgacttccacaccaaccagaaggtgctgggaggagtctcgattctgccctccgagcgcctccgccacagggtggctgcgtcagtaccaacctgatgggccccaatcagggcggcccccatccgggggattttcctttaaatttaagaaagaagaaccccaaaccccccccagggacttttttgcccgaaaaatcccccctccagggccaaaaaaaatcccccccccccacaggaaaacacccctggggggggaaaaatcgccttcccccggccgcccccccccggggggngggggggggcggcccccnaaccnnctcccccccccccccgtttttaacaccccccccttgaagtgtttttaaaccccccccccctttaaaggcgccccccccaaaaaaggg

SEQ ID NO: 40108 - protein, 33 aa, Zea mays
  misc_feature: Ceres CLONE 1431813-F
MTLDFHTNQKVLGGVSILPSERLRHRVAASVPT

SEQ ID NO: 40109 - DNA, 754 bp, Zea mays
  misc_feature: Ceres CLONE 1431815-F
  misc_feature: Encodes the peptide sequence at SEQ ID NO. 40110
  misc_feature (353)..(353): n is a, c, t, g, unknown, or other
  misc_feature (354)..(354): n is a, c, t, g, unknown, or other
  misc_feature (446)..(446): n is a, c, t, g, unknown, or other
  misc_feature (500)..(500): n is a, c, t, g, unknown, or other
aaagctggagctccccgcggtggcggccgctctagaactagtggatcccccgggctgcaggaattcgcacgagaccattacctagaacatcctaatcgaaaacaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgnncacatcagtactacacggaatgcttttggatgaaactgctgaggaaaagggatgttcctgatgagaagtacaccaatgccttccttggcttngggccagagaacacaactttgcagttgaattgaccatacactatggcggtgacnagtatgacatgggaacggggctttgggcattccccaatgctaatgatggatgggaacaatttacctaagaatttcaatcccaggggtgggaaaaatcacccccgaaccttggccctgtcaagggaaggaaccccctgttaatggccttccccccgggaactcggaggggcacccttgttgaaacttttcccagaagggtttaaaccccctggaaccccttttttcccggggaagtgtttctcgcgtgggggaaa

SEQ ID NO: 40110 - protein, 78 aa, Zea mays
  misc_feature: Ceres CLONE 1431815-F
  misc_feature: SWISSPROT Homolog: EC 4.4.1.5 Lactoylglutathione lyase
  misc_feature (38)..(38): Xaa is any aa, unknown, or other
  misc_feature (68)..(68): Xaa is any aa, unknown, or other
MATGSEASKAAEAVVDWHKHDSKRMLHAVYRVGDLDRXHQYYTECFWMKLLRKRDVPDEKYTNAFLGXGPENTTLQLN

SEQ ID NO: 40111 - DNA, 685 bp, Zea mays
  misc_feature: Ceres CLONE 1431816-F
  misc_feature: Translation starting site: 338
aagctggagctccccgcggtggcggccgctctagaactagtggatcccccgggctgcaggaattcgcacgagaccattacctagaacatcctaatcgaaaaaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcaaggatatatagataatatacaaacaaaggttcctccagagcccagagcaggagggaagtcaccggccgtcggcggggaggagatgtcggacggcgcgggctcccggacgggcgtcgctggcgcgctgggcctctcggtcacctcgtcggtggccatcgtcatctgcaacaagtacctcatcagcactctagggcttctttctcgcgacgacgctgacgagctggcacctcatggtgacttttctcagcctgtacgttgcgcaggggctgcgctttctcgagccaaagcgatcgacgcgcgcacggtcttctctttgggcctgctaagggggatctccatggcctcctcaacctttgcttggggttcaacccggttgggtttcacccaaggaccaagggggccttaaacccctttaccatagtctggggac

SEQ ID NO: 40112 - DNA, 694 bp, Zea mays
  misc_feature: Ceres CLONE 1431817-F
  misc_feature: Encodes the peptide sequence at SEQ ID NO. 40113
aaagctggagctccccgcggtggcggccgctctagaactagtggatcccccgggctgcaggaattcgcacgagaccattacctagaacatcctaatccaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcagcaggctaaagggctccacgctccttaccgaaggagtggtgacggatggatccgatgaatgggcaatctacggcgggaccggagagtttgctatggcgagaggtgtcgtcaaaagaagtaccttgccgatagggacggcgccggggaccctgacaagctcagcatgccagttttctgcccggggtttgctcatcccggaaccaacaggcggactccccttcctgtcccaaaatgggttttggggg

SEQ ID NO: 40113 - protein, 182 aa, Zea mays
  misc_feature: Ceres CLONE 1431817-F
  misc_feature (7)..(158): Pfam Name: Dirigent Pfam Description: Dirigent-like protein
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGSRLKGSTLLTEGVVTDGSDEWAIYGGTGEFAMARGVVKRSTLPIGTAPGTLTSSACQFSARGLLIPEPTGGLPFLSQNGFWG

SEQ ID NO: 40114 - DNA, 678 bp, Zea mays
  misc_feature: Ceres CLONE 1431821-F
  misc_feature: Translation starting site: 228
  misc_feature: Pfam Name: Hep_59 Pfam Description: Hepatocellular carcinoma-associated antigen 59
  misc_feature (482)..(482): n is a, c, t, g, unknown, or other
  misc_feature (678)..(678): n is a, c, t, g, unknown, or other
tccccgcggtggcggccgctctagaactagtggatcccccgggctgcaggaattcgcacgagaccattacctagaacatcctaatcgaaaagttcgggattcaaacccttcgatcccaaatctgccctgcacgcctcgccgccggccacacccccggcggtcgtcgccctacccgctcgacccttctccttacctctaaccccgccggagcccaacacctccccaccatgccgcgaaacttccgcaagcggggcatcgagcaggacactgacgaccgctccgacgacgaggacactcgccgcatcgccctcgaggagatcaagtacatgcagaagctccgggagaggaagctgggtatccccgccgacctcgccgccgcatccactaacgggtcctccgcccgtggtctattgggcaccggggcagcggtcgccggtgaggccgagaaggaggacctcgttctccaggacaccttcgctcangagaccgccgtcactatcgaggacccccaacatgtgaggtacgtgaagaccgagctggcgaagaagaggggtaagatggttgatgtgggacacaagaagaagatgaccatgtggacgagctctacaccgtgccagaacacctcaggtaaaagaagaagaactcagaggagagctcgacacaatggacaactggcan

SEQ ID NO: 40115 - DNA, 665 bp, Zea mays
  misc_feature: Ceres CLONE 1431822-F
  misc_feature: Translation starting site: 166
gctctagaactagtggatcccccgggctgcaggaattcgcacgagaccattacctagaacatcctaatcgaaaaattatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccctccccaagaccaatgagaactacaggctgctgtacgaatacaaggggccgcttccgccctccccccatcagggatgaggaagctaagttcaagctttgcaagggtaggtctgttccggttggggcagaagggcatccctttacctgaaccacctatgacgggccgcaaccatccgggtacccctgacccccctcctcaagggccaacgaacccccttcaagaatcc

SEQ ID NO: 40116 - DNA, 720 bp, Zea mays
  misc_feature: Ceres CLONE 1431828-F
  misc_feature: Encodes the peptide sequence at SEQ ID NO. 40117
  misc_feature (397)..(397): n is a, c, t, g, unknown, or other
acccgcggtggcggccgctctagaactagtggatcccccgggctgcaggaattcgcacgagaccattacctagaacatcctaatcgaaaaacccacctccgccagccactccaaacacttgcgccgccactgcctcacaggtaaggccgccatggtctccggttcgggcgtgtgcgcgaagcgcatcgtggtggacgcgcgccaccacatgctgggccgtctctcctcgatcatagccaaggagctgctcaatgggcagaaggtggtcgtcgtccgctgcgaagagatctgcatgtcgggcggcctcgtccgtcagaagatgagtaccctcgcttcctccgcaggcgatgaacaccagccggtccaggggcccatccattcccggccccgcaagatnctgtggcgcccatcccggggattatccccccaaaaccaaaggggggaggcggctctggaaggctaaagattacaaggggttcccccccccttaaaaaaaacaaagtttggccaccccaaacctcttaaggtttgaaggcacaccccggaaaaaaaatctccccccggggaagttcttaaagggggcgggggagaaccccctcaccccccgggaatttttaaaaaaaaaaaaaaaagaccccttttttccccaaagagaaaaacaatttttccccccccttttttttcgccaaaaaaaccccccaaagaaaatttgggccctcc

SEQ ID NO: 40117 - protein, 103 aa, Zea mays
  misc_feature: Ceres CLONE 1431828-F
  misc_feature (11)..(104): Pfam Name: Ribosomal_L13 Pfam Description: Ribosomal protein L13
  misc_feature (82)..(82): Xaa is any aa, unknown, or other
MVSGSGVCAKRIVVDARHHMLGRLSSIIAKELLNGQKVVVVRCEEICMSGGLVRQKMSTLASSAGDEHQPVQGPIHSRPRKXLWRPSRGLSPQNQRGEAALEG

SEQ ID NO: 40118 - DNA, 736 bp, Zea mays
  misc_feature: Ceres CLONE 1431833-F
  misc_feature: Encodes the peptide sequence at SEQ ID NO. 40119
  misc_feature (463)..(463): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacctcctaatcgaaaaacgaaccactcctcctacagaaatcacctggccggcctggcctttccgtagctacaaccgaagccaccaccagcagtcccgcacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaccctcgacgacgttgtcacgccctctcagctccgctcgaccatcgctaaggagatccgtaagaaccagaacgtcaccaacccccannggtgttgatatgcttcctgttcagcccgacggaagtagcctgaccaacataatccaacctgcaaagcgccgtcatcatgggattggccaaaaatttaatccggcaaaaagggcccgggacaaagactgggggccaaagaatttggggaatcttaacttcccgaaaaaaattcccaccacggcaatccttctggaaccggggggcaaaattaaaacctttgggaaaccccccgggggtggccttaaaataaaaaaacactggaggccttttgg

SEQ ID NO: 40119 - protein, 73 aa, Zea mays
  misc_feature: Ceres CLONE 1431833-F
  misc_feature (71)..(71): Xaa is any aa, unknown, or other
  misc_feature (72)..(72): Xaa is any aa, unknown, or other
MAFTMRAVKVPPNSASLEEARHRVFDFFKQACRSIPTVMEIYTLDDVVTPSQLRSTIAKEIRKNQNVTNPXXC

SEQ ID NO: 40120 - DNA, 720 bp, Zea mays
  misc_feature: Ceres CLONE 1431836-F
  misc_feature (246)..(246): n is a, c, t, g, unknown, or other
  misc_feature (290)..(290): n is a, c, t, g, unknown, or other
  misc_feature (397)..(397): n is a, c, t, g, unknown, or other
caaagctggagctccccgcggtggcggccgctctagaactagtggatcccccgggctgcaggaattcgcacgagaccattacctagaacatcctaatcgaaaaagccagccaggcccaggagcgcgagttctgtgcctgtgcctctgctccacctcccctgcccctgcgccccaagtccacgtccaccactcagcactcacgctgctcgctcgctcgctcgtacacgcgcccgcttcgcgcaggtngcgtgtagaacgacggaggcttccatttcgactgaccgtgtgtngtttggatcggacacccctgcaaaacgcgtgagcagcgctgtctgctctgatcggtgtgctgctgtgggttttgttttggttttgttttgctagggaagaaccttgntgggggaagcgaggaactgatgccacccaagtccgaattccgattgacaaacctggggggtttcctccccccccggtccccaaaaaggggggggggggccccggaaagggggtttaaaattgaaaaccccttccgggagatcccaaaaaaggggttaaaaaatccctgctaaaaggcccccccccggggtttaaaaaacccccaaaaagtggcgtttgccaccccccttaggggggccccactcccctcctcccccccggagggcgtttttttccggaaacccccaaaaaggggcccccccgggaaccccagagtgtcttcaa

SEQ ID NO: 40121 - DNA, 838 bp, Zea mays
  misc_feature: Ceres CLONE 1431837-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (397)..(397): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactcaccgcggtggcggccgctctagaatagtggatccccccgggctgcaggaattcgcacgagaccattacctagaacatcctaatcgaaaaacaccactggacgtcagcctagcaattagctcatcgactccagattggagaactcgacaccatgaaggtgctgatcngtgccctttgctctcctgcggcttgctgcaagggccgcctccagtacaaagcgcgggttggggttgccaaaaaccacccgttcatttaaccgcctcccttttaatttggccccccccttttttatttcccccccaaaaaaaacccccggcctttggaaataccccctttaaacccccccagtttaaacccgtgcccaaaatttttaaatcctggggggggttgaaagaatttgagaaccccctttctggggggggggtgggttttaattttttaaaaaaacaaagggtgccccgggggggaaaaccccccttatttgtcccaaaaaggaggggggggggtgaaaaaaaaagggtcgcccccccccaaaaaggggggggggggggcccccctcccccccccaaaaaaaaaaaaaaaaagggggggttgctccccctctctcc

SEQ ID NO: 40122 - DNA, 730 bp, Zea mays
  misc_feature: Ceres CLONE 1431841-F
  misc_feature: Encodes the peptide sequence at SEQ ID NO. 40123
  misc_feature (567)..(567): n is a, c, t, g, unknown, or other
  misc_feature (666)..(666): n is a, c, t, g, unknown, or other
  misc_feature (714)..(714): n is a, c, t, g, unknown, or other
tggagctccccgcggtggcggccgctctagaactagtggatcccccgggctgcaggaattcgcacgagaccattacctagaacatcctaatcgaaaacttttcctttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtaagtgagcgagcgtgcgagccgccctccctccctcccagccggcgtctcgatctcgaatctccccgccgccctccgcccgctccgtgcccgtgctgactgcggcctgctgatgaatgaatggaccgatcaggtgggggtgcgagaagagcaagttcccgtggacctactccgccaaggagacgtgctacctgctgcaggggaaggtgaaggtgtaccccgaaggccacggggaggagttcgtggagatcggcgcgggagaccttgtcgtcttccccaagggcatgagctgcacctgggacgtcgccgaggccgtcgancagcactacaacttcgagtagccgccgccgccgactagccctgcggcgctcgatgtagactggctgtgctcttgtactctgaacctatgatgctccacntcagagttaacagaccgtgtaaataagctccgggattaggggactacnatgctgtactatctgt

SEQ ID NO: 40123 - protein, 74 aa, Zea mays
  misc_feature: Ceres CLONE 1431841-F
  misc_feature (7)..(71): Pfam Name: Cupin_3 Pfam Description: Protein of unknown function (DUF861)
  misc_feature (68)..(68): Xaa is any aa, unknown, or other
MNGPIRWGCEKSKFPWTYSAKETCYLLQGKVKVYPEGHGEEFVEIGAGDLVVFPKGMSCTWDVAEAVXQHYNFE

SEQ ID NO: 40124 - DNA, 681 bp, Zea mays
  misc_feature: Ceres CLONE 1431842-F
  misc_feature: Encodes the peptide sequence at SEQ ID NO. 40125
  misc_feature (320)..(320): n is a, c, t, g, unknown, or other
  misc_feature (337)..(337): n is a, c, t, g, unknown, or other
  misc_feature (481)..(481): n is a, c, t, g, unknown, or other
  misc_feature (482)..(482): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccacccgccgcggttcatctaccgccgccggtgcatctgccacctccggtttcactgccancctcggtgcatctcccnacggccggtccactgccggcgccggtcccactgccaaccccggtcccatgttgccgccgcccgggttcaacttgtcggccccccccatggcccttaccctatttaacccggcccgggccttaaccttattccccagggcccccnnccccttggccgggccaaaggcccgatccaaacccgtgccaattttagggaaccctgggggtttgggagcccccccaatcctgggccaaaggggctaaatttttaaaggggtttttggggcccccaagggggaaaccccctttgtgcccccccaagggccaattttttggggcgacattgtttgcccccacccctccgga

SEQ ID NO: 40125 - protein, 95 aa, Zea mays
  misc_feature: Ceres CLONE 1431842-F
  misc_feature (50)..(50): Xaa is any aa, unknown, or other
MRVLLVALALLALAASATSTHTSGGCGCQPPAAVHLPPPVHLPPPVSLPXSVHLPTAGPLPAPVPLPTPVPCCRRPGSTCRPPPWPLPYLTRPGP

SEQ ID NO: 40126 - DNA, 726 bp, Zea mays
  misc_feature: Ceres CLONE 1431848-F
  misc_feature: Encodes the peptide sequence at SEQ ID NO. 40127
aagctggagctccccgcggtggcggccgctctagaactagtggatcccccgggctgcaggaattcgcacgagaccattacctagaacatcctaatcgaaaaaagcaaaaatgaaaccagcaacggtagcaaagtggcaatggtttcacttccagtccaatcaattccttcgtttgacgttctatccctgactcaggtagtcaggtgtagtgctgctgcggccacagtgctcggcgctcgctcgtgctgcctgctggtgctctgtgctcgagtgctcgacggccgctgcccgctgcgctgggagcttgcgacgagccaacgggtcaccggtcgacggccacccgcgcgccaccgcgccagactgggcgcgccctcctcgccgtgggtcctccactccgggatccggcggcggcggcggcctccctgcggccctgcctgcgccgtgcagtgccgcccctcgccggcggtcggctcaactccctgtccaccacagtgccgagccggcatccacctcctgcttccaccgccagtttgccacagtgccgcgccggcctcccgtccctggtcgaaggccgccaccgccacctactgaattgtgataatgaacgtgacggcggcgaggcagcggaggctgcccccgctcgggccacggcggccactcccgccgccgcgcctcctcgccgctgtcatcgccttcgccttcgcgctcctcttcctgctcctcgtg

SEQ ID NO: 40127 - protein, 42 aa, Zea mays
  misc_feature: Ceres CLONE 1431848-F
MNVTAARQRRLPPLGPRRPLPPPRLLAAVIAFAFALLFLLLV

SEQ ID NO: 40128 - DNA, 680 bp, Zea mays
  misc_feature: Ceres CLONE 1431857-F
  misc_feature: Encodes the peptide sequence at SEQ ID NO. 40129
  misc_feature (680)..(680): n is a, c, t, g, unknown, or other
aaagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggccacgcccacgctggccgccgtgcgggcgctcttccagctccgctcccaccgcgcgctgctggccgccaacggcctcccgctctccacgccgcccacggcgcctgcgcccgtgccgctgcgggtccgcctgccctgcctctgctcggggggcgccgggn

SEQ ID NO: 40129 - protein, 108 aa, Zea mays
  misc_feature: Ceres CLONE 1431857-F
MAPLPASLTPCLWLFLCLLAAPCPAARAARFACNATAPRASTCQALVSYAPPNGTATPTLAAVRALFQLRSHRALLAANGLPLSTPPTAPAPVPLRVRLPCLCSGGAG

SEQ ID NO: 40130 - DNA, 661 bp, Zea mays
  misc_feature: Ceres CLONE 1431858-F
  misc_feature: Encodes the peptide sequence at SEQ ID NO. 40131
aagctggagctccccgcggtggcggccgctctagaactagtggatcccccgggctgcaggaattcgcacgagaccattacctagaacatcctgttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagac

SEQ ID NO: 40131 - protein, 141 aa, Zea mays
  misc_feature: Ceres CLONE 1431858-F
  misc_feature (58)..(140): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEISQ

SEQ ID NO: 40132 - DNA, 573 bp, Zea mays
  misc_feature: Ceres CLONE 1431859-F
  misc_feature: SWISSPROT Homolog: EC 2.1.1.41 Sterol 24-C-methyltransferase
aagctggagctccccgcggtggcggccgctctagaactagtggatcccccgggctgcaggaattcgcacgagaccattacctagaacatcctaatcgaaaaagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcattttgatcgtcccgggcgcctacacgatgtccaagtcgggagcgctggatcttgcttcttggcctcggagggaaaatcaacaaggtggaagtcaagtccgcccgccatgagtttgaaaaattcctggattcctttggggggaaggggagaaccagggaacccactttccgggatggggtaaaaaaaacaatgaaccttgcccccagctttcagagagaagggggggggggaaatcccttccatttttgctccccaagggggagggggaaacctctttccgggaaaacctcccgggggcttggttttt

SEQ ID NO: 40133 - DNA, 668 bp, Zea mays
  misc_feature: Ceres CLONE 1431880-F
  misc_feature: Encodes the peptide sequence at SEQ ID NO. 40134
atagctggagctccccgcggtggcggccgctctagaactagtggatcccccgggctgcaggaattcgcacgagaccattacctagaacatcctaatcgataactagccaccgcatcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccgggacggtggcgctgcgcgagatccgcaagtaccagaagagcacggagctgctgatccggaagttgcccttccagcgcctggtccgtgagatcgctcaggacttcaagacggatctgcggttccagagccacgccgtcctggccctccaggaagccgccgaggcctacctcgtcggcctgttcgaggacaccaacctctgcgccatccacgcaaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttt

SEQ ID NO: 40134 - protein, 136 aa, Zea mays; identical to SEQ ID NO: 35188
  misc_feature: Ceres CLONE 1431880-F
  misc_feature (58)..(132): Pfam Name: Histone Pfam Description: Core histone H2A/H2B/H3/H4

SEQ ID NO: 40135 - DNA, 686 bp, Zea mays
  misc_feature: Ceres CLONE 1431882-F
  misc_feature: Encodes the peptide sequence at SEQ ID NO. 40136
  misc_feature (684)..(684): n is a, c, t, g, unknown, or other
aaagctggagctccccgcggtggcggccgctctagaactagtggatcccccgggctgcaggaattcgcacgagaccattacctagaacatcctaatcgaaaactcttttccgccgcccatggtggccgcgccaccaccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttcttttctcatgcatcagcagagaaagctcttcagaattttactggtcatgtgatgccaaacactgaccggccatttaaattgaactgggcatcgtatagcatgggtgaaaagcgatctgaagtggcttctgatcactcgatatttgttggcgatctagctgctgatgtcactgatgaaatgctgctggagcttttctccagcaagtaccgctcggtgaaaggagctaaagttattattgatgcaaacacaggccgttccaggggctatggatttgtcangt

SEQ ID NO: 40136 - protein, 188 aa, Zea mays
  misc_feature: Ceres CLONE 1431882-F
  misc_feature (50)..(121): Pfam Name: RRM_1 Pfam Description: RNA recognition motif. (a.k.a. RRM, RBD, or RNP domain)
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
MVAAPPPPPQFAKHFAAGPPPPPQAGAGRRTPTPPSSGSGGNGCEENKTIWVGDLQYWMDENYLHNCFGPSGEVVTIKVIRNRQTGQSEGYGFVEFFSHASAEKALQNFTGHVMPNTDRPFKLNWASYSMGEKRSEVASDHSIFVGDLAADVTDEMLLELFSSKYRSVKGAKVIIDANTGRSRGYGFV

SEQ ID NO: 40137 - DNA, 668 bp, Zea mays
  misc_feature: Ceres CLONE 1431887-F
ggagctccccgcggtggcggccgctctagaactagtggatcccccgggctgcaggaattcgcacgagaccattacctagaacatcctaatcgaaaaacgagtgttctgcctcccgaatctcggtcgcgaagagactctccatctccgccgccgccatcatcggcgccaatctcgcgctccgctctgctccgcggcctccacgcccttggtgcccccacccccgtctcccgcccgggtgcctcccctgccccgttcacggtccccgcccccatccctcgaccggcgcgcatgtcgctgctgctgccacagcgcgtacgtgcccccgccccgtcgcgtcctcgccacatcggcgcgccccgtctgagttagcttcaggtctagcgacccgatctggaggcgggcaaaggcgtcacagacgaagatggacttgtctgcgtgcggagccgccgccgcaggcacctgcagtacgatgtcagtgggaatggacagctcggagtcgacggagagcagccccgagcgaaggagcagcgagaggtcgtgcaggaggagcgagagcgaggaggccaccatgtcaaggtcgctctttagccgcagccgccccccggggagcccagggtcctggcaccggacagagagcgcgtggagggaacggagggctgggagaagcg

SEQ ID NO: 40138 - DNA, 668 bp, Zea mays
  misc_feature: Ceres CLONE 1431889-F
  misc_feature: Encodes the peptide sequence at SEQ ID NO. 40139
aagctggagctccccgcggtggcggccgctctagaactagtggatcccccgggctgcaggaattcgcacgagaccattacctagaacatcctaatcgaaaagtgctttcttagaggtgggttggcttctcctccccctccgggtcgggttcgggttcgtgaggttctccggggttcggtttcgtgggtgagcggatcgagatggcggcgtcggatgtgtgagtaccggtgcttcgtcggggggctcgcctgggccacggacgaccagtccctccacgacgccttcagctcctacggcgaggtcctcgagtccgagatcatcctcgatcggcagacgcgtaggtcccgcggtttcggcttcgtctgcttctccggggaggaggcgatgcggaacgccgtcgagggcatgaaccgccacaacctggacgggcgcggcatcgccggcaacgaggcccagtcccagggaggccgtggacgccggcgcggcggcgggtacagtggtggccgtggaggcagggggtgcagaagtggcggggggggtggtggcggctcggggtgcgggggggcccgcggccccggggggggcggcggcggcgggggtggtggtggcggcgcttggctctgttgcggcggtgggctgccgctggggatgactcgggcgggcggggg

SEQ ID NO: 40139 - protein, 151 aa, Zea mays
  misc_feature: Ceres CLONE 1431889-F
  misc_feature (6)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MCEYRCFVGGLAWATDDQSLHDAFSSYGEVLESEIILDRQTRRSRGFGFVCFSGEEAMRNAVEGMNRHNLDGRGIAGNEAQSQGGRGRRRGGGYSGGRGGRGCRSGGGGGGGSGCGGARGPGGGGGGGGGGGGAWLCCGGGLPLGMTRAGG

SEQ ID NO: 40140 - DNA, 684 bp, Zea mays
  misc_feature: Ceres CLONE 1431903-F
  misc_feature: Encodes the peptide sequence at SEQ ID NO. 40141
aaagctggagctccccgcggtggcggccgctctatactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccatagcttgcctataaaggtatgggtcttaccagaaggacaaaaggactgggcgtccaaaaatttggatatacagggacaaagttactaatgaaccaaagggtgatgcaacagtcacctatgaggatccacatgctgcttcagctgctgtggaatggttcgataacaaggatttccatgggagcactattcaggttcacatagctgagtcaaaaagcaaagatgcattcgataaccccacaagtttgaacatcattggtggtgttggtgaacaagatgaactggataatggagcaggcagag

SEQ ID NO: 40141 - protein, 38 aa, Zea mays
  misc_feature: Ceres CLONE 1431903-F
MAGYMSRGPQNGSVYVCNLPPGTDENMLAEYFGTIACL

SEQ ID NO: 40142 - DNA, 662 bp, Zea mays
  misc_feature: Ceres CLONE 1431910-F
  misc_feature: Encodes the peptide sequence at SEQ ID NO. 40143
aaagctggagctccccgcggtggcggccgctctagattagtggatcccccgggctgcaggaatttgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgccccgtccccatccttagcttgtcgggcttccaccagcagccggcgacagccgcgggccttgttagcttgtcccagcggcaggatcccaccctcgggcgtcccggcgggtgccctagcccgggtcccgcccctga

SEQ ID NO: 40143 - protein, 80 aa, Zea mays
  misc_feature: Ceres CLONE 1431910-F
MLLTSCRQGRGMASLSCARADGVVRSGALPAKLLLCASCCFPTAAPVADGEVQVLACRQHLHRLPRRQDLRRQRPPRPHP

SEQ ID NO: 40144 - DNA, 824 bp, Zea mays
  misc_feature: Ceres CLONE 1431911-F
  misc_feature: Encodes the peptide sequence at SEQ ID NO. 40145
  misc_feature (69)..(69): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (650)..(650): n is a, c, t, g, unknown, or other
tgggtccggggcggccgtgcggggcgcgggcttcggcggccccgcggtgggccgcgcgcgggggggggnggggaannnntaaaactggaactccccgcggtggcggccgctctagaactagtggatcccccgggctgcaggaattcgcacgagaccattacctagaacatcctaatcgaaaaactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcatcagggaggaggcgggtgcccgatgggtgagcaggtgaagggcatgctccacgacaagggggccgacggcgtcgcaggtgctgacggtggccacgctgttcccgctggggcgggctgctgcttggtgctgtcgggggttggccgctgacgcccctccggtggtgggggctggccctgggccccccccggggttcccgtgatccttcagccccgttgcttggtccccggcccgccctgctccctccgggaacgggggggaccaagggagtttccttcaccgtccgggagcgcgcctggggcctcggggggggnctggcgcctttccgttaaaggttgccttcggcccaaagccggggggtcgggcatggcggtttcccaggcaccacaccccctggacctaccgttgggagagggagggcccctccccgccaaggaattggcgcgcatagagtctcgcggggtgagaccgcaccgggcaccacaact

SEQ ID NO: 40145 - protein, 70 aa, Zea mays
  misc_feature: Ceres CLONE 1431911-F
MADRDRSGIYGGAHATYGQQQHQGGGGCPMGEQVKGMLHDKGADGVAGADGGHAVPAGAGCCLVLSGVGR

SEQ ID NO: 40146 - DNA, 685 bp, Zea mays
  misc_feature: Ceres CLONE 1431913-F
  misc_feature: Encodes the peptide sequence at SEQ ID NO. 40147
gagctggagctccccgcggtggcggccgctctagtttcagtagatcccccgggctgcaggaatttgcacgagaccattacccagaacatcctaatcgaaaaatgcagcagcgaacaacacatattaactagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctcccacgacgcctgcaaggactggggcttcttctgggtaagcagagcaccaacgaatgcttgcaattaatatttgacaacttctttccatatgcatgcgcgcgggcgtacgtacgtcattatgatgcgccggcgccgctcgcatacgcatcgcaggtggagaaccaaggggtggaacccccgctgatggaccaaggccagcgcttcctctacgggcactaccacgagcacctgggagccaagttcttcgcctccgcccctcggcatggaacttcgagggccccacccagaggtgaaaactgatgagaaagcccttcccacgaggggggaatgggaattccaacgtacttttatccagccaacacccccaaggaccaaaagtcgcccaaattccccaaaaaataccccccgcccgaaag

SEQ ID NO: 40147 - protein, 124 aa, Zea mays
  misc_feature: Ceres CLONE 1431913-F
MEIPVIDLGGLNGGGEERSRTLAELPRRLQGLGLLLGKQSTNECLQLIFDNFFPYACARAYVRHYDAPAPLAYASQVENQGVEPPLMDQGQRFLYGHYHEHLGAKFFASAPRHGTSRAPPRGEN

SEQ ID NO: 40148 - DNA, 521 bp, Zea mays
  misc_feature: Ceres CLONE 1431922-F
  misc_feature: Encodes the peptide sequence at SEQ ID NO. 40149
tggagctccccgcggtggcggccgctctagaactagtggatcccccgggctgcaggaattcgcacgagaccattacctagaacatcctaatcgaaaaaatcaatcaaaaaaaaagttcgttttctttctcaaaccctttctagcgatgtcaggttaccctccgacgagccaaggctacagttacggctacggcggtggaaatcaacctccccctcctcagccaccttactcctccaccggaaacaatcctccgacgagccaaggtcacggttacggctacggcggcggaaacaatcctccgtacggatcatcatctccttacgctgtccctacgcgcgcgaagcccatctcgctgctcctctgtcacgtagctctctctctcagggactcacccgcaagacagcttcggcgcgctacgagctcgcgcgtctgggctacgtgctgctctcccctccggagatacgagctctccccccacccgaaacggggttacgggctggccccgtcttacggggaaacgg

SEQ ID NO: 40149 - protein, 125 aa, Zea mays
  misc_feature: Ceres CLONE 1431922-F
MSGYPPTSQGYSYGYGGGNQPPPPQPPYSSTGNNPPTSQGHGYGYGGGNNPPYGSSSPYAVPTRAKPISLLLCHVALSLRDSPARQLRRATSSRVWATCCSPLRRYELSPHPKRGYGLAPSYGET

SEQ ID NO: 40150 - DNA, 691 bp, Zea mays
  misc_feature: Ceres CLONE 1431930-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (185)..(185): n is a, c, t, g, unknown, or other
  misc_feature (189)..(189): n is a, c, t, g, unknown, or other
  misc_feature (193)..(193): n is a, c, t, g, unknown, or other
  misc_feature (194)..(194): n is a, c, t, g, unknown, or other
  misc_feature (222)..(222): n is a, c, t, g, unknown, or other
  misc_feature (436)..(436): n is a, c, t, g, unknown, or other
  misc_feature (441)..(441): n is a, c, t, g, unknown, or other
  misc_feature (501)..(501): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactgggagctccaccgncggntggnncggccgctctagaactagtggatccccncgggctgcaggaattcgcacgagaccattacctagaacatcctaatcgaaaactctgctaacgccgctcgcgcatcctattgccctcgcgccaccgtcgccgccgctgcagcgagccaccgccctgccgtcgcctgaagtagacaccaagcaccgccatggggcgtatgcacagccccgcggaagggtatctcttttcatcgcgctgccgtacnagaangactcctcccgatctggctcaagacagctaccaacggaagtgggaggaaaatgattaccnaaggctgccaaaaaaggggccacaatggcccttcccaaaatttgggggttctggttcccgtaaacaaaacagggaatccccgttttttcaaaaaccgttaacttggaaaaaaaaaatcctcccccatcccctaaaggcccaaggggtttgccccccaaaaaacccccgaaaaaaattctattttccccaa

SEQ ID NO: 40151 - DNA, 664 bp, Zea mays
  misc_feature: Ceres CLONE 1431933-F
  misc_feature: Encodes the peptide sequence at SEQ ID NO. 40152
aagctggagctccccgcggtggcggccgctctagaactagtggatcccccgggctgcaggaattcgcacgagaccattacctagaacatcctaatcgaaaaaactactccgtcactttgtttgcaaagctcctccccgatccatcgatcactgcaccggccggcggcaccgcgctcgcaggggctagccaaccagacggcagcaatggcggaccgtgaccgcagcggcatctacggcggcgcccacgccacctaccggcagcagcaacaacagggaggaggcgggcgccctatgggtgagcaggtgaacggcatgctccaccacaaggggcccacggcgtcgcaggcgctgacggtggtgacactattccccctagtcgggctgctgctggtgctgtcgggtctagcgctcactgcctccgtggtggggctggccgtggccactccggtgttcctgatcttcagccccgtgctcgtccccgccgcgctgctcatcgggacggccgtcatggggttcctcacgtctggcgcgctggggctcggaggcctgtcctcgctcacgtgcctcgccaacacggcgcggcaggcgttccagcgcaccccggactacgtggaggaggcgcaccacaggatggcggaggccgcagctcacgccggtcacaaga

SEQ ID NO: 40152 - protein, 153 aa, Zea mays
  misc_feature: Ceres CLONE 1431933-F
  misc_feature (44)..(153): Pfam Name: Oleosin Pfam Description: Oleosin
MADRDRSGIYGGAHATYRQQQQQGGGGRPMGEQVNGMLHHKGPTASQALTVVTLFPLVGLLLVLSGLALTASVVGLAVATPVFLIFSPVLVPAALLIGTAVMGFLTSGALGLGGLSSLTCLANTARQAFQRTPDYVEEAHHRMAEAAAHAGHK

SEQ ID NO: 40153 - DNA, 634 bp, Zea mays
  misc_feature: Ceres CLONE 1431937-F
  misc_feature: Encodes the peptide sequence at SEQ ID NO. 40154
  misc_feature (621)..(621): n is a, c, t, g, unknown, or other
aaagctggagctccaccgcggtggcggccgctctagaactagtggatcccccgggctgcaggaattcgcacgagaccattacctagaacatcctaatcgaagagcccactcccagaggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctacatccttgacgcagccgagactgccggtgtgggagtgccatactcgtggccgtgctgggggcttgctcccactgtgcggcaaaatcgagtcctgggtcgntgaccagtcggaa

SEQ ID NO: 40154 - protein, 112 aa, Zea mays
  misc_feature: Ceres CLONE 1431937-F
MSTSTFATSCTLLGNVRTTQASQTAVKSPSSLSFFSQVTKVPSLKTSKKLDVSAMAVYKVKLVGPEGEEHEFDAPDDAYILDAAETAGVGVPYSWPCWGLAPTVRQNRVLGR

SEQ ID NO: 40155 - DNA, 681 bp, Zea mays
  misc_feature: Ceres CLONE 1431943-F
  misc_feature: Encodes the peptide sequence at SEQ ID NO. 40156
  misc_feature (498)..(498): n is a, c, t, g, unknown, or other
aagctggagctccccgcggtggcggccgctctagatctagtggatcccccgggctgcaggaattcgcacgagaccattacctagaacatcctaatcgaaaacaccaaggaaattcacaaagagatactagtccctaccaaagcatacttcctgaaacactcttgcaatccactgagtcctgtttgttgagacttgagacgcatagagctagcgtcgacaatgtcgctcgtgaggcgcagcaacgtgttcgaccccttctccatggacctctgggaccccttcgacaccatgttccgctccatcgtcccgtcggcggtctccaccaactccgagaccgccgccttcgccagcgcccgcatcgactggaaggagacgcccgaggcgcacgtgttcaaggccgacctccccggcgtcaagaaagaggaggtcaaggtcgaggtcgaggacggcaacgtgctggtcatcagcggccagcgcagcagggagaaggagggacanggacgacagtggcaccgcgtcaagcgcagcagcggccagttcgtcaggcggcttccgtctgccggaagaacgcaagggtggaccaaggtcagggctggcctccaaaaatggcgggctcaccggccccggtgccccaaggggaaaaaaaaaaaaccctgaaggtgagggcttttgagactccct

SEQ ID NO: 40156 - protein, 145 aa, Zea mays
  misc_feature: Ceres CLONE 1431943-F
  misc_feature (48)..(145): Pfam Name: HSP20 Pfam Description: Hsp20/alpha crystallin family
  misc_feature (93)..(93): Xaa is any aa, unknown, or other
MSLVRRSNVFDPFSMDLWDPFDTMFRSIVPSAVSTNSETAAFASARIDWKETPEAHVFKADLPGVKKEEVKVEVEDGNVLVISGQRSREKEGXGRQWHRVKRSSGQFVRRLPSAGRTQGWTKVRAGLQKWRAHRPRCPKGKKKKP

SEQ ID NO: 40157 - DNA, 628 bp, Zea mays
  misc_feature: Ceres CLONE 1431969-F
  misc_feature: Encodes the peptide sequence at SEQ ID NO. 40158
aagctggagctccccgcggtggcggccgctctagaactagtggatcccccgggctgcaggaattcgcacgagaccattacctagaacatcctaatcgaaaaaatgtcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggtaaaacctcccccgcgctccggccatgcgccggcgccgcagccgcttgccatcgagcagccatggctcacgatcgacgctctgtgtgtctgcgtgcgtggtttgcaggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcttcgacttcgacttcgtcaccgtcgacaactgccagaagagcaagatcttcttcatcgcctggt

SEQ ID NO: 40158 - protein, 130 aa, Zea mays
  misc_feature: Ceres CLONE 1431969-F
  misc_feature (52)..(130): Pfam Name: Cofilin_ADF Pfam Description: Cofilin/tropomyosin-type actin-binding protein
MAMAYKMVKPPPRSGHAPAPQPLAIEQPWLTIDALCVCVRGLQATEGMNVKEECQRWFMEMKWKKVHRFVVYKIDERSRAVLVDKVGGPGEGYEELVAALPGDDCRYAVFDFDFVTVDNCQKSKIFFIAW

SEQ ID NO: 40159 - DNA, 619 bp, Zea mays
  misc_feature: Ceres CLONE 1431978-F
  misc_feature: Encodes the peptide sequence at SEQ ID NO. 40160
tccccgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccactttccacaccgcggcgtttcggtccgcgggtggaccacctgtcgcagtactccggccaagggcggccgccggtggcatgctttaacttggcccggggcagggggttaacgggcccctttaaactggaacaggcacttttaccccctttacctccccccaaaaagcccgttttttttggggtccccagaaaaaaaggggagaggggcccaacccggggaaaccccccggccctctttacggaaaaa

SEQ ID NO: 40160 - protein, 99 aa, Zea mays
  misc_feature: Ceres CLONE 1431978-F
MAPRTLGFNAAPLLQILRSLCLLALAAAAAVSGRRHGASPARGSGQSMYLAPACRAHTASVADFGGVGDGTTFHTAAFRSAGGPPVAVLRPRAAAGGML

SEQ ID NO: 40161 - DNA, 705 bp, Zea mays
  misc_feature: Ceres CLONE 1431983-F
  misc_feature: Encodes the peptide sequence at SEQ ID NO. 40162
  misc_feature (550)..(550): n is a, c, t, g, unknown, or other
  misc_feature (595)..(595): n is a, c, t, g, unknown, or other
  misc_feature (604)..(604): n is a, c, t, g, unknown, or other
aagctggagctccccgcggtggcggccgctctagaactagtggatcccccgggctgcaggaattcgcacgagaccattacctagaacatcctaatcgaaaatcggtgctcttcaagagcgaatcacaaccaccaagaaaggttccatcacctcagtgcaagccatctatgtccctgctgatgatttgacagatcctgctcctgccacaacctttgcccacttggatgccacaaccgtgctttccagacagatttccgagcttggtatctatcctgctgtggatcctctggattcaacatcccgtatgctctcacctcacattctgggtgaggagcactacaacacggctcgtggtgtgcagaaagtgctacagaattacaagaatttgcaagatattattgccattttgggaatggatgagctaagtgaagatgacaagctgactgttgcccgtgcccgtaagatccagagattcttgagtcagccattccacgttgctgaaatcttcactggtgcccctggaaaatacgttgaccttaaggaaaacatncacagtttcccaggtctgctcgatggcaagtacgatgatcttccntgacaatcngtttacatggttggtggcatcgacgaggtggttgctaaagcagagaagatctcccaggaggccgcagcttaaggggctgatcatccccttttgatgcgtaa

SEQ ID NO: 40162 - protein, 97 aa, Zea mays
  misc_feature: Ceres CLONE 1431983-F
  misc_feature (12)..(98): Pfam Name: ATP-synt_ab_C Pfam Description: ATP synthase alpha/beta chain, C terminal domain
  misc_feature: SWISSPROT Homolog: EC 3.6.3.14 H(+)-transporting two-sector ATPase
  misc_feature (82)..(82): Xaa is any aa, unknown, or other
MLSPHILGEEHYNTARGVQKVLQNYKNLQDIIAILGMDELSEDDKLTVARARKIQRFLSQPFHVAEIFTGAPGKYVDLKENXHSFPGLLDGKYDDLP

SEQ ID NO: 40163 - DNA, 567 bp, Zea mays
  misc_feature: Ceres CLONE 1431993-F
  misc_feature (397)..(397): n is a, c, t, g, unknown, or other
  misc_feature (457)..(457): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacatcctaatcgaaaaatcaagaaaccatgagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaaagattgcagatttgagttatagtccaagaaacgggtgggtgtccgccatgggagtgaagtcccagcaagggctgatggccggggaagggatctttttcggtattcccaaaaaaccccccggnccccgtttttccgggggccccccgcggccccccccccctttaaaaaaaaagaggagggcnccgcggntagtaaaaccaaagaaggaaggcgggtgtgtccccaaaaaaaaaaggggggccccccttttttttttcccgggggggggccccccccccttttttttttcccc

SEQ ID NO: 40164 - DNA, 697 bp, Zea mays
  misc_feature: Ceres CLONE 1431994-F
aaactggagctccccgcggtggcggccgctctagaactagtggatcccccgggctgcaggaattcgcacgagaccattacctagaacatcctaatcgaaaattccccatctccggataaaaaataaggagtgtctctcctttgccatcctcctctctttcagctaagttcctgccccctctctttttcttacattcaggtcctcggagctcctctctttattcttgtttctttcgatctgctagccgtccaagtccagtactcttctttccctcaaagaactcttgcagacggcccctctggtttcctccaattcttgttacccggtccctcctcatgtccccgcgtacatccgtccgtccaaggagcacaccatccccacccccatgtttacccaccaattactctgacggacgccgtgcaccgatgaagatgatcgtgctccgtatccgccgctcccacaccttctccgtcgccttcctctactgaatctacgtcttctcatgaacacatcgaccctctccaactgctgatccttcgacgtctctccctctcacattatctctgagatagtctttctaatccatatatagggatcctgtttctacccatactagctccacccaacccctgatgaaaccgattcaatccgacaatacgagcatccatgttgtcttcacgcaagaactccagccctg

SEQ ID NO: 40165 - DNA, 605 bp, Zea mays
  misc_feature: Ceres CLONE 1431995-F
  misc_feature: Encodes the peptide sequence at SEQ ID NO. 40166
  misc_feature (158)..(158): n is a, c, t, g, unknown, or other
  misc_feature (166)..(166): n is a, c, t, g, unknown, or other
tggagctccccgcggtggcggccgctctagaactagtggatcccccgggctgcaggaattcgcacgagaccattacctagaacatcctaatcgaaaaaagttgtttctcttctcttgctccgcaaaccagcgcaagcccttccctgacagcggcggcngacatggntgctcgaggcgacgatgatctgcatagacaactcggagtggatgcggaacggcgactacgccccgtcgcggttccaggcgcaggccgatgccgtcaacctcatatgcggtgccaagacccagtcgaacccggagaacacagtaggcgtgatgacgatggccgggaagggcgtccgcgtgcttgtcactcccaccagcgacctcgggaagattctcgcctgtatgcacgggttggaagttggtgctgaggcaaacttggctgcggcaatccaggttgctcagcttgcgctaagcatcgcagaacagaggcagcagcagaggatatagcatcatcggagtcctgtgagtacacaagaaaatttggagacatccggaagagctgaaaaaacaaggtgctcctgacatggtggactttgggaattgatgataaaagcttaaaa

SEQ ID NO: 40166 - protein, 103 aa, Zea mays
  misc_feature: Ceres CLONE 1431995-F
MICIDNSEWMRNGDYAPSRFQAQADAVNLICGAKTQSNPENTVGVMTMAGKGVRVLVTPTSDLGKILACMHGLEVGAEANLAAAIQVAQLALSIAEQRQQQRI

SEQ ID NO: 40167 - DNA, 858 bp, Zea mays
  misc_feature: Ceres CLONE 1432002-F
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (78)..(78): n is a, c, t, g, unknown, or other
  misc_feature (79)..(79): n is a, c, t, g, unknown, or other
tttccccggtttcttaatcgccaccacatcccacccccctaggcctttcttttttgggggtgttnnnnnttaattttnntcaaactggagctccccgcggtggcggccgctctagatctagtggatcccccgggctgcaggaatttgcacgagaccattacctagaacatcctaatcgaaaaatagggaacaaacatcgagtacagtcggctacgtaatctggtggtacgacgacatggtggccaccaggagcaagtcgacgtcgtcctcgagatcggcgcagggggcagctgccgcactgatcgtggccgccgccgtggcggtgtccgtcctgttggggggggcggaggcggtgtgcgacatgagcaacgagcagttcatgtcctgccagcccggggcggtacagactgacggacccgtcagcgcgcgccagtcacagggcgcgctgcccattctccttttcgggggggggggcggggggggggcttctttaatcttaattaaaaaattggcccgtaggaatgggggggtcctccccaggttccgaaccccccaagttgccggcccctggggagcctcttccgcgcccaaaggtgcgggtggtctctcttccccgcgactcgctcccggacttcggccgggcaccgtggggcctagcgggcgaagctctcaaccgcgcccccggggaagagggcccctccgtgctttttgccgaacgcccggcccgcgccgtctgggtgtgggcgaatcctgccgaacagggggggccacggcgagccgacccccgtaaaaagagggggggccccgttggtagtgtgcaaaagccggggtacccgcgggcccggtcactcggagggg

SEQ ID NO: 40168 - DNA, 712 bp, Zea mays
  misc_feature: Ceres CLONE 1432019-F
aaagctggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaaggtcaccaagctctgcgatttggggcctagggacagcgtatgcgcagtgcattggtcacgggaaggctcttatctttccattggcaccggccttggagatgtccagatttgggatagttctcgttgtaagcggatttagaatatgggaggtcaccaaacaaggactggggtattagca

SEQ ID NO: 40169 - DNA, 695 bp, Zea mays
  misc_feature: Ceres CLONE 1432027-F
aaagctggagctccccgcggtggcggccgctctagaactagtggatcccccgggctgcaggaattcgcacgagaccattacctagaacatcctaatcgaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactcccttctcgtcgccttcctctactggttctacgtcttctcatgaacgcatcgccccctctcaactgctgatccttcgccgtctctccctctctctttctctctgagatagtctttcgaatccatctctagggcctctgtttctccccatcttccccccacccacccccaaaaaaaaggattcaatccgaaaagaaaaggatccctggtctccgtcaccccgaaaccggagcc

SEQ ID NO: 40170 - DNA, 691 bp, Zea mays
  misc_feature: Ceres CLONE 1432034-F
  misc_feature: Encodes the peptide sequence at SEQ ID NO. 40171
  misc_feature (691)..(691): n is a, c, t, g, unknown, or other
agagctggagctccccgcggtggcggccgctctagaactagtggatcccccgggctgcaggaattcgcacgagaccattacctagaacatcctaatcgagaaaaaatctcccaaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggacattcagctcgcccgccgcatccgcggggagcgcgcttatgcggttacggttgaatgccactactgtaaatgtttacggcatgttctcgccctgccccagggccgccttgtccttatttgttttn

SEQ ID NO: 40171 - protein, 165 aa, Zea mays
  misc_feature: Ceres CLONE 1432034-F
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERAYAVTVECHYCKCLRHVLALPQGRLVLICF

SEQ ID NO: 40172 - DNA, 634 bp, Zea mays
  misc_feature: Ceres CLONE 1432039-F
  misc_feature: Encodes the peptide sequence at SEQ ID NO. 40173
  misc_feature (551)..(551): n is a, c, t, g, unknown, or other
  misc_feature (561)..(561): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgcccgccccagtgcctgcccccgcacgagggccagccgtgggagacccagnagtgcatganggggtggccgccgccgcgactggccgtcaacatggagcaagaataccgtccgcggcaacaaaaagcccgggcn

SEQ ID NO: 40173 - protein, 140 aa, Zea mays
  misc_feature: Ceres CLONE 1432039-F
  misc_feature (113)..(113): Xaa is any aa, unknown, or other
  misc_feature (116)..(116): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECPPQCLPPHEGQPWETQXCMXGWPPPRLAVNMEQEYRPRQQKARA

SEQ ID NO: 40174 - DNA, 744 bp, Zea mays
  misc_feature: Ceres CLONE 1432040-F
aaagctggagctccccgcggtggcggccgctctagaactagtggatcccccgggctgcaggaattcgcacgagaccattacctagaacatcctaatcgaaaaaagtccagaacctcgcttccaatctgccctcccgtgtccccctccctgtccgattccccacagtagcgcctcgccctcgtcctcctcctccagtccggatcgccatttcccaccgatccgtcccggcatcggcatggctgcgcccaagccaaaggcgccggcgcccagtgcttcggcagcctagcgtttgtttgcctccgaggatttccgcctatcgcgttaccggatcttcggtgggccggcgaccctctacgccactatgagctccgacgggcgcctccgccgcgcgctggccgcgttcggcggccacccgtgggaccctcgtggacgcggggctcgccgccgccgcgcgggacagccccggcgacctgcgcgcgcgtcgcgacggcttcttccagcgccctcttccaaggggcagcccgctgccccaactgggaactccaccccaccccggggccctgttaactcaaggaagggcaaaggaccccctcccctcctgtttctttctccttcgcccggcggctacccggccatttccggcccccccctgtaaacaggacgtctataccccggaatgtcttttttcccccttccataaataccccgcctacaccttctgcgcaggggtggacaactaccccg

SEQ ID NO: 40175 - DNA, 664 bp, Zea mays
  misc_feature: Ceres CLONE 1432041-F
  misc_feature: Encodes the peptide sequence at SEQ ID NO. 40176
aagctggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgctttttag

SEQ ID NO: 40176 - protein, 118 aa, Zea mays; identical to SEQ ID NO: 12523
  misc_feature: Ceres CLONE 1432041-F
  misc_feature (13)..(116): Pfam Name: MAP1_LC3 Pfam Description: Microtubule associated protein 1A/1B, light chain 3

SEQ ID NO: 40177 - DNA, 1022 bp, Zea mays
  misc_feature: Ceres CLONE 1432047-R
ggggccccccccaaggcacagggtcgatatcttttttttttttttttttaccggacccacactgatatagagaaatccactcataaaaaagacatcactactcataagtctgatccaacagtcatcaaaagcacacaccaaacaagtcctcagtttttaacttaaaacattattcttaaagatgggagtctcagtactcaacacacactcactctcttgacctctttcccttactcctcatcatcatcattcatcatcatcttccttcttcaaacgagtctcccccccttccttaaaaatagggcaacttcttgggaccaaaacgggggttcaaacatccccattccccttttaaataaataccccggtccctttcccactatatttttatccaaaagggggggcacccccaattcctggggggcctaaaacgtttatcggggaattttaaaacaaccccgcctcccggttttttttcaaaggctttataagaaaacccgtattttttggcgccttgtcccaagagattttaagggaatggacaaaagccaacaacctttctaaaggcgaaaaaattttttatatggcctcccaaagatgtaaaagatgagtttctccgtgttttcccgaaaacccctctttcagggggacaaaaattatggtcatttcgttctttccttattcaataacaacaataaaattttttggagaaaattataatattttttcttcaacagagcaagaaaaattatggtggtttcaaggggggggagagaaaggagaaagtcatagaggaagcacggtattccgagtatggggaaaagagtttgattgatcttcccccgaaataaaaaggtccctacttttcacccaatgtagggaggtacaagcgctttcactctccgtaccgaagagtgagtgcttctctcatccctaccggactttctattatctctgctctatatatatgcgctcatgcggcgccagcacgcatcctaaacacttaataggaagtatggagg

SEQ ID NO: 40178 - DNA, 630 bp, Zea mays
  misc_feature: Ceres CLONE 1432048-F
  misc_feature: Encodes the peptide sequence at SEQ ID NO. 40179
  misc_feature (440)..(440): n is a, c, t, g, unknown, or other
  misc_feature (469)..(469): n is a, c, t, g, unknown, or other
aaagctggagctccccgcggtggcggccgctctagaactagtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcatgagccggccataaccatgaggtacccacaaggggcgcgctcctgtcgggaccccatcgcccgtcaactcatctgtacggcgacttctcggcgcgcagcgagcgcgatcaccgactcgtctcgtcntgacgggggctgcccccggcgcggcgcanccggagccgtcggtggcccctgggttaagaacgggccccaagtactacccccggttccaagggggccgtttccgggggggttgcgccttggttcccaaggccttcaaacggaaatggtccccttggaaagcccctaaaggaaaaggaccctgcccagcccc

SEQ ID NO: 40179 - protein, 130 aa, Zea mays
  misc_feature: Ceres CLONE 1432048-F
  misc_feature (76)..(76): Xaa is any aa, unknown, or other
  misc_feature (86)..(86): Xaa is any aa, unknown, or other
MACYNTASLAATLLAFALTFQACLAGRRLTALVHEPAITMRYPQGARSCRDPIARQLICTATSRRAASAITDSSRXDGGCPRRGAXGAVGGPWVKNGPQVLPPVPRGPFPGGLRLGSQGLQTEMVPLESP

SEQ ID NO: 40180 - DNA, 697 bp, Zea mays
  misc_feature: Ceres CLONE 1432049-F
  misc_feature: Encodes the peptide sequence at SEQ ID NO. 40181
  misc_feature (473)..(473): n is a, c, t, g, unknown, or other
  misc_feature (530)..(530): n is a, c, t, g, unknown, or other
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactccccgtggcctccgcacactcaactctgtttgggcccnacatcttagcgaagaagtgagggagagggtctacaagaactgggtgcagagcagaangaagctttcacaaagtatgctctcaaatataaaatgatgctggcaagaaggaattcanctgcagcttgaaagatgaagaattttgcttctgttatccggggcttggctaaccccaattagggaaaataagggtttgaaccaaaaaaggttcccctgaggggaattcg

SEQ ID NO: 40181 - protein, 138 aa, Zea mays
  misc_feature: Ceres CLONE 1432049-F
  misc_feature (50)..(138): Pfam Name: Ribosomal_L3 Pfam Description: Ribosomal protein L3
  misc_feature (108)..(108): Xaa is any aa, unknown, or other
  misc_feature (127)..(127): Xaa is any aa, unknown, or other
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLNSVWAXHLSEEVRERVYKNWVQSRXKLSQSMLSNIK

SEQ ID NO: 40182 - DNA, 677 bp, Zea mays
  misc_feature: Ceres CLONE 1432050-F
  misc_feature: Encodes the peptide sequence at SEQ ID NO. 40183
  misc_feature (564)..(564): n is a, c, t, g, unknown, or other
aagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagcccacaacttcgctcgtggtcactacaccattggcaangagatgttgaactgtgccttgaccgcatcaggaagcttgcagataattgcactggtctccaggggttcctcgtcttcaacctttttggtggaaggaccggctcttggctttgt

SEQ ID NO: 40183 - protein, 149 aa, Zea mays
  misc_feature: Ceres CLONE 1432050-F
  misc_feature (49)..(146): Pfam Name: Tubulin Pfam Description: Tubulin/FtsZ family, GTPase domain
  misc_feature (112)..(112): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAAHNFARGHYTIGXEMLNCALTASGSLQIIALVSRGSSSSTFLVEGPALGF

SEQ ID NO: 40184 - DNA, 714 bp, Zea mays
  misc_feature: Ceres CLONE 1432054-F
  misc_feature: Encodes the peptide sequence at SEQ ID NO. 40185
aagctggagctccccgcggtggcggccgctctagaactagtggatcccccgggctgcaggaattcgcacgagaccattacctagaacatcctaatcgaaaaaaaagcgcttctctcgctagcgagttcggcagtagaaaccctaaaaaaaaagacaccgccctctccttcgctagcggaaccgccctcccctcgccggggtaggggtttcgggggtagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgacctctttcagctcacgaaaatggatctcggtcctttgtctaagaatcattctctttcactgcggaaagattatgaagaagcgaaagcaaaaggaacagaaaattttgatagagaactcgaggatatgatagaaaggctcatttgtggagtgtgacaggaaaaatccaaaagggcccctaaaacggcttgcaaaatgatgaatgccaatgctgctattgcgaatatcgggcccttggagggtacctctgaacggatgactatactgcagcttgtcaaaaacgaaaaaagggaaaaaatgggcaaaaattttaatcccttttgtatttttaaaggggaaacctggttcacaaatataa

SEQ ID NO: 40185 - protein, 94 aa, Zea mays
  misc_feature: Ceres CLONE 1432054-F
MDAFRKQLDVLMGANRNGDVEEVSRNYYDRDVCRLFLAGLCPHDLFQLTKMDLGPLSKNHSLSLRKDYEEAKAKGTENFDRELEDMIERLICGV

SEQ ID NO: 40186 - DNA, 670 bp, Zea mays
  misc_feature: Ceres CLONE 1432057-F
  misc_feature: Encodes the peptide sequence at SEQ ID NO. 40187
gcggtggcggccgctctagtttagtggatcccccgggctgcaggaatttgcacgagaccattacctagaacatcctaatcgaaaagtcgttctcgtctttcggtactcgcgcgcgccagctcacttctctacttcccttccccagatctacctccattcttccctcaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctgtggtcaaacaagcatcaggccatactggcggtgctactttccaaacacccaggctatcatatatgttgttgattcaagcgatacagataggcttgtaacagcaaaagaagaattccatgccatccttgaggaggatgaacttaaaggtgcagttgtccttgtgtatgcaaataagcaggtgcactcgatgatgctgccattacagagtcattagaactacacaaaattaagagccgccaatgggcgattttcaaaacatctgcaataaagggagaggggctcttcgaaggtttggactggctcagtaacacgctcaaa

SEQ ID NO: 40187 - protein, 105 aa, Zea mays
  misc_feature: Ceres CLONE 1432057-F
  misc_feature (5)..(105): Pfam Name: Arf Pfam Description: ADP-ribosylation factor family
MGIVFTRLFSSVFGNREARILVLGLDNAGKTTILCGQTSIRPYWRCYFPNTQAIIYVVDSSDTDRLVTAKEEFHAILEEDELKGAVVLVYANKQVHSMMLPLQSH

SEQ ID NO: 40188 - DNA, 777 bp, Zea mays
  misc_feature: Ceres CLONE 1432062-F
  misc_feature: Translation starting site: 278
  misc_feature (68)..(68): n is a, c, t, g, unknown, or other
  misc_feature (665)..(665): n is a, c, t, g, unknown, or other
  misc_feature (699)..(699): n is a, c, t, g, unknown, or other
gcaggctgtagctccccgcggtggcggccgctctagaactagtggatcccccgggctgcaggaattcncacgagaccattacctagaacatcctaatcgaaaaaattcacacaaccaatcactttataccatatagcaaatactctcatggctactaaattcgtcaccctcggtcaagtccaccgccccaaaatctcaatttccaccagaaaacctcgtaaatgcaaccaaaacaagccccaaccatccaaatccataagcgagaacctgttcaacaatggtttttcctgagaaaccggtgacggaaaatctatcacgtggcctaaacaaatccagaccccccttactacctacagaattggttgatgggagggggaggcgggggaaaaaaggaggggagggtggtaaaaaggggaaagaccgggccgccccccccctttggtggtctgttgataaggtgaggggggagttgtgatggggcgggccgggggaagaacaccccataccttggtgggtcttcgagggggtggcggaattgtggtggagggggggctgcggacgagagaaagacggctttcggtgcacggccggcgaccgcacgcacgccccacacacccctctccgggggaaacgataggtctggggggggacggccgtcggtgggncgggaggggacccgggcagcacgagaggcgtcgncgcaaccctccgcaccgtagtagaagcaccacaacagttgggtcgcccaaccgccagaaccagaccccgagccccccc

SEQ ID NO: 40189 - DNA, 706 bp, Zea mays
  misc_feature: Ceres CLONE 1432066-F
  misc_feature: Encodes the peptide sequence at SEQ ID NO. 40190
  misc_feature (706)..(706): n is a, c, t, g, unknown, or other
aagctggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattcggaaaacttcacggtcgagaactctgttctgttn

SEQ ID NO: 40190 - protein, 155 aa, Zea mays
  misc_feature: Ceres CLONE 1432066-F
  misc_feature (58)..(156): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEISQTIDSENFTVENSVL

SEQ ID NO: 40191 - DNA, 750 bp, Zea mays
  misc_feature: Ceres CLONE 1432067-F
  misc_feature: Encodes the peptide sequence at SEQ ID NO. 40192
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (26)..(26): n is a, c, t, g, unknown, or other
  misc_feature (27)..(27): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (110)..(110): n is a, c, t, g, unknown, or other
  misc_feature (143)..(143): n is a, c, t, g, unknown, or other
  misc_feature (146)..(146): n is a, c, t, g, unknown, or other
  misc_feature (149)..(149): n is a, c, t, g, unknown, or other
  misc_feature (165)..(165): n is a, c, t, g, unknown, or other
  misc_feature (169)..(169): n is a, c, t, g, unknown, or other
  misc_feature (434)..(434): n is a, c, t, g, unknown, or other
  misc_feature (437)..(437): n is a, c, t, g, unknown, or other
  misc_feature (438)..(438): n is a, c, t, g, unknown, or other
  misc_feature (504)..(504): n is a, c, t, g, unknown, or other
  misc_feature (545)..(545): n is a, c, t, g, unknown, or other
  misc_feature (584)..(584): n is a, c, t, g, unknown, or other
  misc_feature (585)..(585): n is a, c, t, g, unknown, or other
nccccgcgggnnnngggannnttttnnccnccttannnnnnggggtgggggggttcatggtggggctcaccttcgcggcggccgccccgtgctaacggggcccccgggcngcagggtttccacaaccgcgttggcgagaacanccnaancgaaaaagaacagctncggnttctagattatctccgatggagaagctgcggaaagtagtgaaggagatcgcctacacgagagaccacactaactcccctgcacttcaccgctcactagttccctttctcaccttcgcttcttccctctacggagtcgccctccatatccgccgctctctttaccgctcctccttcttccatcaacaccgattgccggttccggtgatcagcgtcgggaatctgagctggggaggtaatgggaagacgccaatggttgagtaggtnacnnagctgctcctctcttctgggatctctccccttattctcactcgtggttacgctggtggtgatgaanccaaaatgcttcgaagacatctccaaggtggacccccaaanatcggtgttggaccaaacaggggagctactgctgcctcnngttttgaaaagtatgggctgtgcaaacccatcttagcttcaggaccttcctttgaatcgcgccccttactccctgtcagcgggcaacaattcgaaaaccctgttgggccaagaaaaattgggggcacttcccatcctaagaaggacgcggcaatcccacaaccgc

SEQ ID NO: 40192 - protein, 81 aa, Zea mays
  misc_feature: Ceres CLONE 1432067-F
  misc_feature: SWISSPROT Homolog: EC 2.7.1.130 Tetraacyldisaccharide 4'-kinase
MEKLRKVVKEIAYTRDHTNSPALHRSLVPFLTFASSLYGVALHIRRSLYRSSFFHQHRLPVPVISVGNLSWGGNGKTPMVE

SEQ ID NO: 40193 - DNA, 725 bp, Zea mays
  misc_feature: Ceres CLONE 1432095-F
  misc_feature: Translation starting site: 172
  misc_feature (461)..(461): n is a, c, t, g, unknown, or other
  misc_feature (462)..(462): n is a, c, t, g, unknown, or other
  misc_feature (534)..(534): n is a, c, t, g, unknown, or other
  misc_feature (575)..(575): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgcccgcggttcatctgccgcccgccacatgccactaccctactcaaccgcccgggctcagcctcatccccanngcacaccatgcccgtgccaacagccgcatccaagcccgtgccagctgcagggaacctgcgggcgtggcagcnacccgatcctgggccagtgcgtcgagtttctgagggatcantggaagccgacggcaaccccctactggtcgccccaatgccagtcgttgcggaaacaaggttgcccccatctcaggcagggggaaccgcaacccccggaaccagggaattttcgggttgggcctcccagccattcgggaaaagaggcccgc

SEQ ID NO: 40194 - DNA, 714 bp, Zea mays
  misc_feature: Ceres CLONE 1432097-F
  misc_feature: Encodes the peptide sequence at SEQ ID NO. 40195
ggagctccccgcggtggcggccgctctagaactagtggatcccccgggctgcaggaattcgcacgagaccattacctagaacatcctaatcgaaaaatctgattctgatcgcaccgccgtcggcccaccgcttcagttggcagttgcgagtggctccaacaatccaccggcaccaacccagcgcggcgccaccggcgacccgtaccccctcccccggagagcgatggcgacggagctgacggcggcgcagctgcgcgcgtacgacggcaccgacccgtccaacccatctacgtctccgtccggggcaggtctacgacgtccctccggccgcggcttctacggccccggcggcgcctacgccgtcttcgcgggccgcgaggccagccgcgccctcggcaagatgtccaaggacgaagccgacgtctccggggacctctccgggctcaccgacaaggagctcggcgtcctcgccgactgggagatcagttccagggccagtaccccgtcgtcgcccgactcgccggcgacgcctgaactcgtcagtctcggtctaaatttactctgtcctgcctcttgccgtggtcagagctgtgcttgcttgcttgttgctagttgctttgctacccaataatctgaatggaaggacctatgtgatgtgcctgctgaatagttcctagaccttgcaaacactgctgtgctacaacatgacatgaa

SEQ ID NO: 40195 - protein, 135 aa, Zea mays
  misc_feature: Ceres CLONE 1432097-F
MATELTAAQLRAYDGTDPSNPSTSPSGAGLRRPSGRGFYGPGGAYAVFAGREASRALGKMSKDEADVSGDLSGLTDKELGVLADWEISSRASTPSSPDSPATPELVSLGLNLLCPASCRGQSCACLLVASCFATQ

SEQ ID NO: 40196 - DNA, 744 bp, Zea mays
  misc_feature: Ceres CLONE 1432113-F
  misc_feature: Encodes the peptide sequence at SEQ ID NO. 40197
ggagctccccgcggtggcggccgctctagaactagtggatcccccgggctgcaggaattcgcacgagaccattacctagaacatcctaatcgaaaaagctgtctccctagcgaggagacgaagaaaggggaaatcgagagatgagctaccatagagtccctcccgaggaaccctaccctcctccaggatatcctctatctcaggcgcacccttaccgaccgccaccagatgtgtacccgcctccccctcgaggccatggacatccgccagctccccatggcgtgtacccgccgccgccgcaaggtccttatccgctaccacagcagcctccaccggggtaccagggctacttcgacgaccagcttcgtccttactacctggcgccgactggagagcatgcatcacactccatcatggaaactacgtagctcctctgggttcctcaaagatgattggctgacctctgcatctgtgcacgctggaggaatgtgcagcgcttcttaaacttgaatggtccgaaatctaatcggagttttcggggttggggttcgggaccccccggttttctcaaataaaaaaacttgggttgggaaagactttgaaaaacccggggtaaagggcccccccccccccggtttttgcccccaatttgttgggggggttttaaaaattttcccagaaacccgcccctttttggggggtcccctaaaaaaaaacaacaaaaaatttttttttttctttttc

SEQ ID NO: 40197 - protein, 95 aa, Zea mays
  misc_feature: Ceres CLONE 1432113-F
MSYHRVPPEEPYPPPGYPLSQAHPYRPPPDVYPPPPRGHGHPPAPHGVYPPPPQGPYPLPQQPPPGYQGYFDDQLRPYYLAPTGEHASHSIMETT

SEQ ID NO: 40198 - DNA, 699 bp, Zea mays
  misc_feature: Ceres CLONE 1432117-F
  misc_feature: Encodes the peptide sequence at SEQ ID NO. 40199
  misc_feature (371)..(371): n is a, c, t, g, unknown, or other
  misc_feature (426)..(426): n is a, c, t, g, unknown, or other
aagctggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcngatgggtgatgtgagcgtctgggttgtcagcggcgccgcccgaggggcagcgggntggcggcggcaatggagctgcatcatcaggcgcagaaagaggctatggcgcccgcagcaggctcaggctcccccccctcttcttggacttccccgcatggaggtaaggcaaatccaacaaagccccactcctgggctcccccggcggattttcttcttcttgggcaggaacccccgcccccctttggttcccatatttcgaatccgaaaaaaaggccccccgggaaattaaatttgcggggttgcttgtgggcccaataaatatacggggggg

SEQ ID NO: 40199 - protein, 82 aa, Zea mays
  misc_feature: Ceres CLONE 1432117-F
MELHHQAQKEAMAPAAGSGSPPSSWTSPHGGKANPTKPHSWAPPADFLLLGQEPPPPFGSHISNPKKRPPGKLNLRGCLWAQ

SEQ ID NO: 40200 - DNA, 722 bp, Zea mays
  misc_feature: Ceres CLONE 1432128-F
  misc_feature: Encodes the peptide sequence at SEQ ID NO. 40201
  misc_feature (413)..(413): n is a, c, t, g, unknown, or other
  misc_feature (443)..(443): n is a, c, t, g, unknown, or other
  misc_feature (446)..(446): n is a, c, t, g, unknown, or other
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctggggcggctgctgctggtgctgtcggggctggcgctgacngcctccgtggtggggctgggcgtggccacnccngtgtcctgatnctcagccccgtgctcgtccccgcgcgctgctcatcgggaacgccgtcatggggttcctcacgtcgggccccctgggctcgggggcccttccctccctccagtggcctccccaaaacgggggggagggttcccaccccccccggaaataggggagaagggcccccccagaagggggaagggccgggcccacggggccaaaaaaccccaagggggcccagcctcccgggggaggcccaaaaggccccccccgggaaaattcaattcc

SEQ ID NO: 40201 - protein, 83 aa, Zea mays
  misc_feature: Ceres CLONE 1432128-F
MADRDRSGIYGGAHATYGQQQQQGGGGRPMGEQVKGMLHDKGPTASQALTVVTLFPLGRLLLVLSGLALTASVVGLGVATPVS

SEQ ID NO: 40202 - DNA, 710 bp, Zea mays
  misc_feature: Ceres CLONE 1432194-F
  misc_feature: Encodes the peptide sequence at SEQ ID NO. 40203
aagctggagctccccgcggtggcggccgctctatactaatggatcccccgggctgcaggaattcgcacgagaccattacctagaacatcctaatccaaaaaaataaccggaaggaacagccactccaatatacagagcgcagccagcacaaaatcatattctttttttcataccgctggccctgcaattgggaggctctcactgcgttgctagccggcaggattaacctttgccctacccattatatcggacgggaagaataacagcgccaatcgtcgcgttcatcgcgaaataactcaattcaatttttttgacgagagatacctagatatcacaatgctgacttggctgggcactggggctggatggccttcaagacactgcctagagcatatttctgggataccttgaatgctcatcctgtagtgggatatgacaaatctcaaaagcgaacgactaccgtacaataaagatgttaagcctggagactgccgctcatgctcaagtcttccacatttggcagcacaaacaaagattgcacccagtgacatgcagactgaagatgtcaagcctcgacgaccagttcacgtcagacaaagtagatggattccttggtgatgtaaccgaggagtaggatcataattcttgaaagcttgggaagactacggagattctgaaaaatgactattttatcatcacgctagtgggat

SEQ ID NO: 40203 - protein, 61 aa, Zea mays
  misc_feature: Ceres CLONE 1432194-F
MTNLKSERLPYNKDVKPGDCRSCSSLPHLAAQTKIAPSDMQTEDVKPRRPVHVRQSRWIPW

SEQ ID NO: 40204 - DNA, 647 bp, Zea mays
  misc_feature: Ceres CLONE 1432237-F
  misc_feature: Encodes the peptide sequence at SEQ ID NO. 40205
ccccgcggtggcggccgctctataactagtggatcccccgggctgcaggaattcgcacgagaccattacctagaacatcctaatcgaaaacaagaagtggtatgtacaaaaaccagctggggcttgaagctactacccaagcaccagcaaaagagcaggatcttttgtttgctaatggttcacatcctgccatgaaggatcagtataatcaggctgactttgcggaaacatactcagacgctaaattcttcattattaaatcttacagtgaagatgatgttcacaagagcgttaagtacaatgtgtgggctagcactcccaatggtaataagaaacttgatgctgcctatcaagaggctaaagaaaaatcaagcgaaactcctgtttttcttcttttctctgtgaatgcaagtggccagtttgtcggccttgctgaaatggtgggtcgtgttgattttgaaaaaacagtagagcattggcaacaggacaaatggactggttgtttccctgtcaagtggcacattgtgaaagatgttccaaacagcttgctgaagcacatcattcttgagaaacatgaaaacaagccagtgaccaacagcagaaatccccttgaagtggagcttgacaagggcttccagtgccaaaaa

SEQ ID NO: 40205 - protein, 182 aa, Zea mays
  misc_feature: Ceres CLONE 1432237-F
  misc_feature (97)..(181): Pfam Name: YTH Pfam Description: YT521-B-like family
MYKNQLGLEATTQAPAKEQDLLFANGSHPAMKDQYNQADFAETYSDAKFFIIKSYSEDDVHKSVKYNVWASTPNGNKKLDAAYQEAKEKSSETPVFLLFSVNASGQFVGLAEMVGRVDFEKTVEHWQQDKWTGCFPVKWHIVKDVPNSLLKHIILEKHENKPVTNSRNPLEVELDKGFQCQK

SEQ ID NO: 40206 - DNA, 729 bp, Zea mays
  misc_feature: Ceres CLONE 1432255-F
  misc_feature (215)..(215): n is a, c, t, g, unknown, or other
  misc_feature (216)..(216): n is a, c, t, g, unknown, or other
  misc_feature (220)..(220): n is a, c, t, g, unknown, or other
  misc_feature (222)..(222): n is a, c, t, g, unknown, or other
  misc_feature (223)..(223): n is a, c, t, g, unknown, or other
  misc_feature (251)..(251): n is a, c, t, g, unknown, or other
  misc_feature (252)..(252): n is a, c, t, g, unknown, or other
  misc_feature (254)..(254): n is a, c, t, g, unknown, or other
  misc_feature (315)..(315): n is a, c, t, g, unknown, or other
  misc_feature (316)..(316): n is a, c, t, g, unknown, or other
  misc_feature (498)..(498): n is a, c, t, g, unknown, or other
  misc_feature (525)..(525): n is a, c, t, g, unknown, or other
aagctggagctccccgcggtggcggccgctctagatctagtggatcccccgggctgcaggaattcgcacgagaccattacctagaacatcctaatcgaaaaacccaggccgcggccgcatcctctccccatcggcagtcttcccccaagacgtctaaaccccaatccctaaatccccgacgcagaccacacgacgcgcacctccgttcacgaggnncggnannagcatggagttccgccccacccccgaanntncactaagtgggcacagaggtccgacaggggtgtcttgacgatagagctgcccgacgcccanngatgtgaagctgaacttgaagccctgaaggcccattttcaacttcccccagcctaaagggggcccaaaaggaaatttggccccctattaaatttgaaatttgaaccgttttggagccttggaaatggggaaggaaaaaacaaaaagaccttttttgtcccccccgggggacaccatatgggncccgccagaaaggaaaagcccccaaancggggggggggggcccaagggtggttctaaaacaggagggggcaacaccccccgggggtttcttaaagggggtttggggaacaaaagggggcggaaacaaaaaaaaataaacaacccccgtttttaaaacccttttggggggggggggggcctcccccaaaagggggaaaaaagaaggggggggtgaaaaaacaaaaatttggg

SEQ ID NO: 40207 - DNA, 666 bp, Zea mays
  misc_feature: Ceres CLONE 1432270-F
  misc_feature (666)..(666): n is a, c, t, g, unknown, or other
ggagctccccgcggtggcggccgctctagaactagtggatcccccgggctgcaggaattcgcacgagaccattacctagaacatcctaatcgaaaagccttttcaacccggcgcaaacagatcgggagagagagagagagagtgaaataaggtctccaccagcggcgtccgtttcgtcgtggggcgcgggtcaccggtggcgcgcagttttcgctggcgcgctaatctctggggcagggtatggcgcggatggagcctaggcggtcatcggtgctccctgcgtgagttcgtgacttcaccggggtccttgtgcgtgctcgccagagtcctggaaatctggcggagatgcgccgtcgtgtggaccgggaactagcgctgccttcctcgggagaagaacaggtggttcaagaggagccacataacgaggagttcgattcgatctaggtggcgtctcccagttgactttctggcaccaatgatggattttagttcgatttatatttatattttattttgtaagacttccgctatgtaataagtactctaattatattgtgacatttatctctatacactctattatatgtgttgccaaaaaaaaaaaaaaaaaagcttatcgataccgtcgacctcgagggggggcccggtacccaattcgccctatan

SEQ ID NO: 40208 - DNA, 672 bp, Zea mays
  misc_feature: Ceres CLONE 1432286-F
  misc_feature: Encodes the peptide sequence at SEQ ID NO. 40209
  misc_feature (520)..(520): n is a, c, t, g, unknown, or other
tggagctccccgcggtggcggccgctctagaactagtggatcccccgggctgcaggaattcgcacgagaccattacctagaacatcctaatcgaaaaagcccctccgggccatgggcaagtacatgcgcaaggccaaggcttccagcgaggttgtcatcatggatgtcgccgccgctccgctcggagtccgcacccgagcgcgcgccctcgcgctgcagcgtctgcaggagcagcagacgcagtgggaggaaggtgctggcggcgagtacctggagctaaggaaccggaggctcgagaagctgccgccgccgccggcgaccacgaggaggtcgggcgggaggaaagcggcagccgaggccgccgcaactaaggaggctgaggcgtcgtacggggagaacatgctcgagttggaggccatggagaggattaccagggagacgacgccctgcagcttgactaacacccagatgactagcactcctgggtccacgagatctagccactcttgcccacgcaggntgaacgctccctcggtgcacgccgtccccaagtctagggagatgaatgagtacttcgctgccgaacagcgacggcaacagcaggattttcattgacagtaccacttcgatcctgcaaacgactgccctcttcccagcaggtttgagtgggtg

SEQ ID NO: 40209 - protein, 167 aa, Zea mays
  misc_feature: Ceres CLONE 1432286-F
  misc_feature (137)..(137): Xaa is any aa, unknown, or other
MGKYMRKAKASSEVVIMDVAAAPLGVRTRARALALQRLQEQQTQWEEGAGGEYLELRNRRLEKLPPPPATTRRSGGRKAAAEAAATKEAEASYGENMLELEAMERITRETTPCSLTNTQMTSTPGSTRSSHSCPRRXNAPSVHAVPKSREMNEYFAAEQRRQQQDFH

SEQ ID NO: 40210 - DNA, 580 bp, Zea mays
  misc_feature: Ceres CLONE 1432304-F
  misc_feature: Encodes the peptide sequence at SEQ ID NO. 40211
  misc_feature (347)..(347): n is a, c, t, g, unknown, or other
  misc_feature (440)..(440): n is a, c, t, g, unknown, or other
cgcggtggcggccgctctagaactagtggatcccccgggctgcaggaattcgcacgagaccattacctagaacatcctaatcgaaaagttagaggtacgccgattcgaaccatccagtctccgtgtccagtcgagtctcagcaaggaagatgtgggggaaaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttncaggacggcaagactctccccacccgcaaaggtatatcactccaattagatcagtggaagaatactgaggacaaacatcaaagcataaatgangcaatcgaggaaaatacatgatggggagccgcaagcagtcacgtgacgggcgagcttttgctcctccccggttgaagcctgatgtaccgaagtattttttgttgccatatgctggccggttgcttttgccttttgacccc

SEQ ID NO: 40211 - protein, 103 aa, Zea mays
  misc_feature: Ceres CLONE 1432304-F
  misc_feature (1)..(99): Pfam Name: PC4 Pfam Description: Transcriptional Coactivator p15 (PC4)
  misc_feature (66)..(66): Xaa is any aa, unknown, or other
  misc_feature (97)..(97): Xaa is any aa, unknown, or other
MWGKGKKRFGGGGSGEPAAKRQAARDDGPSESAEDGTVVAEISKNKKVSVRSWKGRVFVDLREFYXQDGKTLPTRKGISLQLDQWKNTEDKHQSINXAIEENT

SEQ ID NO: 40212 - DNA, 668 bp, Zea mays
  misc_feature: Ceres CLONE 1432314-F
  misc_feature: Encodes the peptide sequence at SEQ ID NO. 40213
  misc_feature (488)..(488): n is a, c, t, g, unknown, or other
cgcggtggcggccgctctagaactagtggatcccccgggctgcaggaattcgcacgagaccattacctagaacatcctaatcgaaaactctctttctcaaagttcggagtcgaggccgccgcccagaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcccttctttctcaccttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcnaagactgcagctgctcccatttgacgagtgaagctgcttattcagaatcaggatgaaatgatcaagtctggtaagctttcaaaaccgtacaaggtatttgttgattgcttcaacctcccttcaaggagagggttttcccttccgtggggaaggggaaacaccgcaaagggaatcccttcc

SEQ ID NO: 40213 - protein, 108 aa, Zea mays
  misc_feature: Ceres CLONE 1432314-F
MADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPI

SEQ ID NO: 40214 - DNA, 681 bp, Zea mays
  misc_feature: Ceres CLONE 1432334-F
  misc_feature: Encodes the peptide sequence at SEQ ID NO. 40215
  misc_feature (378)..(378): n is a, c, t, g, unknown, or other
  misc_feature (447)..(447): n is a, c, t, g, unknown, or other
aaacctggagctccccgcggtggcggccgctctagaactagtggatcccccgggctgcaggaattcgcacgagaccattacctagaacatcctaatcgaaaaaggcccaaatatatctccccgcgtccgctagccctagccgccgtccgccgacttcatcgtcgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccanggaaggtgtgtgatctgtggaggagtcggcatctcagacgcttactactgcaaggagtgcacccagcangagaaggaccgggacggttgccccaagatcgtgaatctcggaagcgccaagacggatctcttctatgagcgcaagaagtatggttttaaaaagagatgaccgaaaagatggagctgtgtgtggttcactttggctgggtggtctgttctttggccctgaatactgagagtaggcagaaagaaacagcagcttttggattcccggttatggtttggaaattggatacctcccatg

SEQ ID NO: 40215 - protein, 110 aa, Zea mays
  misc_feature: Ceres CLONE 1432334-F
  misc_feature (1)..(106): Pfam Name: PHF5 Pfam Description: PHF5-like protein
  misc_feature (55)..(55): Xaa is any aa, unknown, or other
  misc_feature (78)..(78): Xaa is any aa, unknown, or other
MAKHHPDLIMCRKQPGIAIGRLCEKCDGKCVVCDSYVRPCTLVRVCDECNYGSFXGRCVICGGVGISDAYYCKECTQXEKDRDGCPKIVNLGSAKTDLFYERKKYGFKKR

SEQ ID NO: 40216 - DNA, 653 bp, Zea mays
  misc_feature: Ceres CLONE 1432336-F
  misc_feature: Translation starting site: 148
  misc_feature (517)..(517): n is a, c, t, g, unknown, or other
  misc_feature (545)..(545): n is a, c, t, g, unknown, or other
  misc_feature (572)..(572): n is a, c, t, g, unknown, or other
  misc_feature (609)..(609): n is a, c, t, g, unknown, or other
ctccccgcggtggcggccgctctagaactagtggatcccccgggctgcaggaattcgcacgagaccattacctagaacatcctaatcgaaaatagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcagcctcaggncacctgtgctagggtggacattggtcangtactccttttctgtcgatgcaaggancacaatgctgcacatgccagtgaagctctgcgacgcngcaagtttcagttccctggccgcaaaaagattattgaaagcaga

SEQ ID NO: 40217 - DNA, 697 bp, Zea mays
  misc_feature: Ceres CLONE 1432345-F
  misc_feature: Encodes the peptide sequence at SEQ ID NO. 40218
ggagctccccgcggtggcggccgctctataactagtggatcccccgggctgcaggaattcgcacgagaccattacctagaacatcctaatcgaaaatagtcgttactgacttctcgcttgcctgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccagggccattgagaagcatgctgctcagctttgcgttctggctgaggactgtgacccgccagattatgtcaagctggtgaaggcggtctgtgcccccccccatgttcaccttgtcactgttcctgctgctaaaactcgctggcgagggggctggggctttgcaaaaattgactccgaagggcaggcaaggaaaggtggaaggctgcccctggtgccgttggccagggactaccgtggaagaatctgaggggcctttaacattaggggcaggaataatgtccacggccccccttaaaggggaccacggttttcgacaaaaacccccacattttgggattgggggcataaaaaaggtaaggctcccccgccctttgggggtt

SEQ ID NO: 40218 - protein, 129 aa, Zea mays
  misc_feature: Ceres CLONE 1432345-F
  misc_feature (25)..(119): Pfam Name: Ribosomal_L7Ae Pfam Description: Ribosomal protein L7Ae/L30e/S12e/Gadd45 family
MADQEAPVAVEAPTPVLGEPMDLMTALQLVMKKSSAHDGLVKGLREAARAIEKHAAQLCVLAEDCDPPDYVKLVKAVCAPPHVHLVTVPAAKTRWRGGWGFAKIDSEGQARKGGRLPLVPLARDYRGRI

SEQ ID NO: 40219 - DNA, 673 bp, Zea mays
  misc_feature: Ceres CLONE 1432355-F
  misc_feature: Translation starting site: 201
tggagctccccgcggtggcggccgctctataactagtggatcccccgggctgcaggaattcgcacgagaccattacctagaacatcctatgaaaaagcctcgccgccccaccaccccagcattgccttaccttgccttgccttcccctccattccacctccacctcgccgcccgaatcccccccaacccaacaatcccccatggggtcgctggccatcgaggcgcaccgcgcgggcgcggaggtgtaccgcggcgcggcgctgtgcgcggagaagtcgacggagctgctggcagaggcgcacctcccgctgggcctgctgccgctgggcgacatggaggaggtcggctacaaccgcgccacgggcttcgtgtggctgcgccaggaggaagtcgctcacgcacacgttccgcccgatcgcgcgccaggtctcgtacgccgccgaggtcaccgccttcgtggaggaccggcggatgaagcgcatgaccggggtcaagaccaagggagctcctcatctgggtcaccctctccgacatgttcgtcgacagggacgacccgtccaagatcaccttcaagacgcccaccgggctcggcaggaactaccccgttctcgccttcgcaaagaaggcaccggtggcgacggcgcggcggccaggcacaaggatgatgcccccc

SEQ ID NO: 40220 - DNA, 668 bp, Zea mays
  misc_feature: Ceres CLONE 1432357-F
  misc_feature: Translation starting site: 167
  misc_feature (366)..(366): n is a, c, t, g, unknown, or other
  misc_feature (367)..(367): n is a, c, t, g, unknown, or other
  misc_feature (373)..(373): n is a, c, t, g, unknown, or other
acccgcggtggcggccgctctagaactagtggatcccccgggctgcaggaattcgcacgagaccattacctagaacatcctaatcgaaaaacgcggaaaccctagcagctcaacaccctcgaggtacctccattcgcagtcggccgtgtcctcggagccgcgggagatggcggatcaggagacagtagctgtggttgaggcacctaccccggttctaggggaaccgatggacctgatgactgccctgcagctcgtcatgaagaagtcaggtgctcacgatggccttgtgaagggtcttcgtgaggctgccaaagcatcgagaagcatgccgctcagctcttgcgtgcttgcccgaaggactggccnnacccanccctgaatatgttcagctggtgaaggctctctgcgctgaacacaatgtccacttgggtactgtgcctaccgccaaactctttgaaagggggctgggcttttgcaaatccacttctaaggcaggcgaagaagggtttaacctccccctggtttttgccaaggaatccgggaaaaaatctgagggcgtttaacttgggggggagagacgcaaacccccaaaaaaacttttgcgaattttgggagaggtggtttccaccccattttttgccccgagaaaaaaaaagggggtgtggttg

SEQ ID NO: 40221 - DNA, 664 bp, Zea mays
  misc_feature: Ceres CLONE 1432361-F
  misc_feature: Encodes the peptide sequence at SEQ ID NO. 40222
tggagctcaccgcggtggcggccgctctagaactagtggatcccccgggctgcaggaattcgcacgagaccattacctagaacatcctaatcgaaaagcgccacgattgcagagccagagcgagacgcgactgcttttctgcttcatccacattggtagctagctagcttacacgttcacgcatcgctttccgggccgtctccggtggtttagctcagcagagcggggaaggaagaagatgacctccgtgagcgcgaggcccgttggcgtggggtactgcttcggcggggcgaggtgccagccacggtcgcgggtgcgggtttcggccgcggcctcggcagtggccgcgcccgcgcccgcgatggcggcgacgatgtacgagctgctcgccgtcgaggagacggcggggcccgaccacatcaaggcggcgtaccggcgcgccgcgcggaggtggcacccggacgcgtgccccggcggcgccgaccgcttcatggcggcgcgggaggcctacgaagtgctgtccgaccccaagcgcaggcgcggctacaacatccagctccgctgcggcgcccacttcggcgacgccgggaaccgcgcggcacgccgcgcccgggtcgcccgactgggaagcgcatctgaacgggcttgcatgccgcgcggaggg

SEQ ID NO: 40222 - protein, 142 aa, Zea mays
  misc_feature: Ceres CLONE 1432361-F
  misc_feature (45)..(104): Pfam Name: DnaJ Pfam Description: DnaJ domain
MTSVSARPVGVGYCFGGARCQPRSRVRVSAAASAVAAPAPAMAATMYELLAVEETAGPDHIKAAYRRAARRWHPDACPGGADRFMAAREAYEVLSDPKRRRGYNIQLRCGAHFGDAGNRAARRARVARLGSASERACMPRGG

SEQ ID NO: 40223 - DNA, 603 bp, Zea mays
  misc_feature: Ceres CLONE 1432374-F
  misc_feature: Encodes the peptide sequence at SEQ ID NO. 40224
  misc_feature (52)..(52): n is a, c, t, g, unknown, or other
  misc_feature (56)..(56): n is a, c, t, g, unknown, or other
  misc_feature (57)..(57): n is a, c, t, g, unknown, or other
  misc_feature (590)..(590): n is a, c, t, g, unknown, or other
aagctggagctccccgcggtggcgggcgctctagaactagtgggatcccccngggnnctgcaggaattctgcacgagaccattacctagaacatcctaatcgaaaatcggttggtcctcacccgcgcgtggatggcgcacgcgcctctctcctccaagtgcgccgtcgacaccaagctcccctgcctcaccgcgcgatctccagccccgccgcgctcgcaagtcttgagatcgagcagatccacatccctgcgcctcgcccatcacgcactcaccttggcccggcatccctgcgccgccattaccgtgggctcgccctcggcttcatctcccctggcccccggacgggaatcaaaggggtaaaaatcaagcgttctgtcccccccaaaatacctggcccattgcccaccccggggggggcccccccacccccgggggcgccccggcgggaaaaagaccccccaagggggggggttcccccccccctggggccccccggttttttttttataaaaaaaaaaaggggggggccccccccccccccccgcttttttttgttttttcctccccgcgggggggaattttcttttngggggaggaaaaa

SEQ ID NO: 40224 - protein, 76 aa, Zea mays
  misc_feature: Ceres CLONE 1432374-F
MAHAPLSSKCAVDTKLPCLTARSPAPPRSQVLRSSRSTSLRLAHHALTLARHPCAAITVGSPSASSPLAPGRESKG

SEQ ID NO: 40225 - DNA, 666 bp, Zea mays
  misc_feature: Ceres CLONE 1432380-F
  misc_feature (244)..(244): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (487)..(487): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (552)..(552): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (598)..(598): n is a, c, t, g, unknown, or other
  misc_feature (656)..(656): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
ggtggcggccgctctagaactagtggatcccccgggctgcaggaattcgcacgagaccattacctagaacatcctaatcgaaaaagtcgagcagcggtagccggtaggcgagagagtcaggattcaggacgcggcgaggccccatgagcactctcagttctgccgggaaatgcacaacatgctgtacccgcgggaggacaagagacgcgcacctcctgtacgcgtgcaaacgtgcgagcatgangagattgcactgatacttgtgtgtacaaaaggttatccgtaagcctggtgtggacccaaaaatgcctggaggatgcacaattgatcctaactgccccccaccaaaagggtaaaagtgtcactggcccctcccaaaaacgcccttttttcggcccaaaagaaaaacacattctcttttttnnnnttttttttctgccccccccgggggggggggaaaaaaaggggaaaaaaaaattccttttcncccccccaaaaccacagatttannnnaaacaaaaaaaaggtggcgcccaacaaattgttggcccntttttttccccccccccccaaaaagggggnnngggggaaaagaaanttttttttttttttaaaaaaaaaaaaaaaaaaccccccccgttttttgtgcccccccnccccttnnnc

SEQ ID NO: 40226 - DNA, 706 bp, Zea mays
  misc_feature: Ceres CLONE 1432383-F
  misc_feature: Encodes the peptide sequence at SEQ ID NO. 40227
  misc_feature (84)..(84): n is a, c, t, g, unknown, or other
  misc_feature (310)..(310): n is a, c, t, g, unknown, or other
  misc_feature (363)..(363): n is a, c, t, g, unknown, or other
  misc_feature (417)..(417): n is a, c, t, g, unknown, or other
  misc_feature (424)..(424): n is a, c, t, g, unknown, or other
  misc_feature (425)..(425): n is a, c, t, g, unknown, or other
  misc_feature (439)..(439): n is a, c, t, g, unknown, or other
  misc_feature (483)..(483): n is a, c, t, g, unknown, or other
  misc_feature (548)..(548): n is a, c, t, g, unknown, or other
aaagtggagctccaccgcgtggcggccgctctgtttctaggggatcccccgggctggaggaattctcacgagaccattacctanaacatcctagtggaaaagccaagccgcgactgcccctcgacctgcccgcgtcctccgacgcctagggttttctaccgggcgccgccgccgcagctgcggccggggatgcgggtgggcccgcgcagttagccgcttttggatccaccgccgccgcgcgccatgtctcgcctgcggcggcggaagcagcagcagctgccgccctcggagggcgacgggtccgatcacnacgacaatgacaaggggaagaagccgtcctcgtcctccgcgccgcggtccaangagcccacgaggcggaccaaggccaagtggtcgtgcgtggacagctggtgctgnctccccnngtgcgtgtgctgcncctggtgggggcggctctttctcttacacgcgatgccggcttcnttcccgccgtatggaacgaaggccatccggggtcccctcgcggacccccccggggttcagcttcnaaaagggagggcctgcgagcttaaccccccggccttctttgtcccccggcatccttcacccgggggccttccaacttatgggaagggaccccattgtccccgaagggttctctttccgcaaacccgtctattggtgcggctaccttttggagaccaaa

SEQ ID NO: 40227 - protein, 154 aa, Zea mays
  misc_feature: Ceres CLONE 1432383-F
  misc_feature (23)..(23): Xaa is any aa, unknown, or other
  misc_feature (40)..(40): Xaa is any aa, unknown, or other
  misc_feature (58)..(58): Xaa is any aa, unknown, or other
  misc_feature (61)..(61): Xaa is any aa, unknown, or other
  misc_feature (66)..(66): Xaa is any aa, unknown, or other
  misc_feature (102)..(102): Xaa is any aa, unknown, or other
MSRLRRRKQQQLPPSEGDGSDHXDNDKGKKPSSSSAPRSXEPTRRTKAKWSCVDSWCXLPXCVCCXWWGRLFLLHAMPASFPPYGTKAIRGPLADPPGVQLXKGRACELNPPAFFVPRHPSPGGLPTYGKGPHCPRRVLFPQTRLLVRLPFGDQ

SEQ ID NO: 40228 - DNA, 729 bp, Zea mays
  misc_feature: Ceres CLONE 1432477-F
  misc_feature: Translation starting site: 198
  misc_feature (328)..(328): n is a, c, t, g, unknown, or other
  misc_feature (354)..(354): n is a, c, t, g, unknown, or other
  misc_feature (382)..(382): n is a, c, t, g, unknown, or other
tccccgcggtggcggccgctctagaactagtggatcccccgggctgcaggaattcgcacgagaccattacctagaacatcctaatcgaaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtactngcggaggaaggtggggggcccagacngaagtgcgggacttgaagggcgacggcnaagtgcaggagcttcgccggttctccgtcgccgagtacaaccgcacctccaaaagggtggcgccgcggcggcagctccatttcgaagggtggtggccgccacccgcagggggggtccgggctaaagaccacctccgcccctggccctaaaaaaggcgggccgggaaaacggggaaaaacggttttaaaccccttttttttaaaaaccccggtttctttccccccccctttttatttttcccccgggggccccaaaaaacggggggcccccccccgcggaaaaacaaaaaaaaaaaatttgggcgccctccccaagaaaaagggggcacaaaaaaactggttgttgtt

SEQ ID NO: 40229 - DNA, 685 bp, Zea mays
  misc_feature: Ceres CLONE 1432478-F
  misc_feature: Encodes the peptide sequence at SEQ ID NO. 40230
  misc_feature (685)..(685): n is a, c, t, g, unknown, or other
agctccccgcggtggcggccgctctagaactagtggatcccccgggctgcaggaattcgcacgagaccattacctagaacatcctaatcgaaaaagtcagtccatccaccaaaccagcactcgcttcgctccaccaccagctcgaaacccatggaagcggaggcgttcccgatacggttcacgcggggcgttcgcgcctactggcggcgccaaaagtaccaccgcctgcaggcgggcgccgacggcaagcagccccgctcgcggcagctgggctccggcggcggcggcggcgcgcgcgtgcggcggcgggtgcgcgtgctcctggcgggcccgcggcgcgcgctggcgcgggcgcgggacgcgtacgtgggcggcatgctggcgctgggcaggcgcgcgtcggcgctcgcgctgccgggcgccgtcgaggcgctctgggccaagcggctgccgcgccacaagcagcagcagctgctgctcccggcgcccggcaagcccacggagttcgagcagcgcctcatcttggagatctacaagtccatcgtcgcgtccaaggagctcaccaccatgctccactcctccgccgcgcacctgccgcccgccgccttggcgccggggctcccgtccacgcacctcctccaaatgtgatgagccgcgccgttggaggaaaaaggacagaacgccn

SEQ ID NO: 40230 - protein, 165 aa, Zea mays
  misc_feature: Ceres CLONE 1432478-F
MEAEAFPIRFTRGVRAYWRRQKYHRLQAGADGKQPRSRQLGSGGGGGARVRRRVRVLLAGPRRALARARDAYVGGMLALGRRASALALPGAVEALWAKRLPRHKQQQLLLPAPGKPTEFEQRLILEIYKSIVASKELTTMLHSSAAHLPPAALAPGLPSTHLLQM

SEQ ID NO: 40231 - DNA, 720 bp, Zea mays
  misc_feature: Ceres CLONE 1432488-F
  misc_feature: Encodes the peptide sequence at SEQ ID NO. 40232
  misc_feature (573)..(573): n is a, c, t, g, unknown, or other
  misc_feature (608)..(608): n is a, c, t, g, unknown, or other
  misc_feature (650)..(650): n is a, c, t, g, unknown, or other
ctccccgcggtggcggccgctctagaactagtggatcccccgggctgcaggaattcgcacgagaccattacctagaacatcctaatcgaaaaatccagtcacgaaaaatcggaatctctgaaaaatcctccgtaccatgaagctccggttgcgatctatgcaggcgcgcggcggctccgccgccgtggagacccaccgcgtggacctgccgcccacggccactctggccgacgtgaagaccctcctcgcgtcgaagctctctgcggcgcaacccgtccccgccgagtccgtccgcctctccctcaaccgtagcgaggagctcgtctcgccggaccctgccgctacgctcccgtccctcggcctcgcgtccggtgatctcgtatttttcaccctatcccccctcacggccctagcgctgccggctcaggccctgccacggaaccctagcccgagctctggcgctgcagcgtcgatccctgaggctgccgactgcgggaaggggttcgaaagcatctggtactggagatttctctttcttcgtcactggcgcaggctgtgggttgtgagccctanctttcccggtcgcttcgggaccccggaatgtggtngattgaagaaggaggccttcaatccccccaaggcctgggtcnagttttggggcttagggatcctcagaagggaaatgggacaacctccggggcccccggaagagaccccccc

SEQ ID NO: 40232 - protein, 194 aa, Zea mays
  misc_feature: Ceres CLONE 1432488-F
  misc_feature (146)..(146): Xaa is any aa, unknown, or other
  misc_feature (158)..(158): Xaa is any aa, unknown, or other
  misc_feature (172)..(172): Xaa is any aa, unknown, or other
MKLRLRSMQARGGSAAVETHRVDLPPTATLADVKTLLASKLSAAQPVPAESVRLSLNRSEELVSPDPAATLPSLGLASGDLVFFTLSPLTALALPAQALPRNPSPSSGAAASIPEAADCGKGFESIWYWRFLFLRHWRRLWVVSPXFPGRFGTPECGXLKKEAFNPPKAWVXFWGLGILRREMGQPPGPPEETP

SEQ ID NO: 40233 - DNA, 719 bp, Zea mays
  misc_feature: Ceres CLONE 1432490-F
  misc_feature: Encodes the peptide sequence at SEQ ID NO. 40234
  misc_feature (457)..(457): n is a, c, t, g, unknown, or other
  misc_feature (536)..(536): n is a, c, t, g, unknown, or other
acccgcggtggcggccgctctagaactagtggatcccccgggctgcaggaattcgcacgagaccattacctagaacatcctaatcgaaaagcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttcctttttcactcaaaatatgagctgctacttcagcaaaggtccgcgacaaaggttaccctttcctttagtttgggacaantacctgctgcagccacccttctgtaccggggagtctgagcttatccaggaagaacttacctgggtggtgagaaatgcancccacaaggaagctactgggatgagctggggcttcccagcggaaagagcccccaattggaccaattcccccttctggggccaaatgctttacaaggccacccttctgacaaaaaatggggggaacatgaaacttgacacccccggctggtccccccccggggaaggggaagggcccccccaac

SEQ ID NO: 40234 - protein, 99 aa, Zea mays
  misc_feature: Ceres CLONE 1432490-F
  misc_feature: SWISSPROT Homolog: EC 5.3.3.2 Isopentenyl-diphosphate Delta-isomerase
  misc_feature (88)..(88): Xaa is any aa, unknown, or other
MAAAVVDDAGMDAVQKRLMFEDECILVDEQDNVVGHESKYNCHLMEKIDSENLLHRAFSVFLFHSKYELLLQQRSATKVTLSFSLGQXPAAATLLYRGV

SEQ ID NO: 40235 - DNA, 688 bp, Zea mays
  misc_feature: Ceres CLONE 1432497-F
  misc_feature: Encodes the peptide sequence at SEQ ID NO. 40236
  misc_feature (688)..(688): n is a, c, t, g, unknown, or other
ctccccgcggtggcggccgctctagaactagtggatcccccgggctgcaggaattcgcacgagaccattacctagaacatcctaatcgaaaaattcaagctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccaggagattgcgtgcgcgcaggacgcgctgagacacaaggcatcatcctatcccacggtacggtatatataatctaatctcgctgctgctttttggcgccccagcaagcatgcagttcgttcacatgccaataaccaaccaatcgatggagttcggcgggttcaggcagtagggccggcgtccggcgacgcaggcataggagttcacatgcgtcgacgtgaccgtggaagccctaggagtgcaggggtcgtcgttcctggtgaacgtgttctccgacaagagctgcccggggctgn

SEQ ID NO: 40236 - protein, 75 aa, Zea mays
  misc_feature: Ceres CLONE 1432497-F
MMSRERKKAAALQEKLKILRSITHSHALSNTSIIMDASAYIKELKQKVVRLNQEIACAQDALRHKASSYPTVRYI

SEQ ID NO: 40237 - DNA, 676 bp, Zea mays
  misc_feature: Ceres CLONE 1432499-F
  misc_feature: Encodes the peptide sequence at SEQ ID NO. 40238
  misc_feature (375)..(375): n is a, c, t, g, unknown, or other
  misc_feature (588)..(588): n is a, c, t, g, unknown, or other
  misc_feature (676)..(676): n is a, c, t, g, unknown, or other
tcttaactagtggatcccccgggctgcaggaattcgcacgagaccattacctagaacatcctaatcgaaaaaaggaaacagtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcangtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgcccccgcgcccactgaaaccatacgcacaccgggtggggccgaagcgaccttctccgtcaaatacgtgtcgagctaatctnattattggttccaataatataaaaagccttccccctgtctctatggacctatagtaggatactagtaagttgcgagggagccataaan

SEQ ID NO: 40238 - protein, 169 aa, Zea mays
  misc_feature: Ceres CLONE 1432499-F
  misc_feature (81)..(81): Xaa is any aa, unknown, or other
MATHRHCLPLLLLVAAALAAVPARAALGGGRGPLLGGWNPIPDVSDSHIQELGGWALGQAKHQKLAADGLRFRRVVRGEQXVVSGMNYRLYVDAADPAGRTVPYVAVVYEQVWTRTRQLASFNPVPPRPLKPYAHRVGPKRPSPSNTCRANLIIGSNNIKSLPPVSMDL

SEQ ID NO: 40239 - DNA, 744 bp, Zea mays
  misc_feature: Ceres CLONE 1432501-F
  misc_feature: Encodes the peptide sequence at SEQ ID NO. 40240
  misc_feature (395)..(395): n is a, c, t, g, unknown, or other
tccccgcggtggcggccgctctataactagtggatcccccgggctgcaggaattcgcacgagaccattacctagaacatcctaatcgaaaaaaggaaacagtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcangtcgtgtccgggatgaactaccgcctctacgtcgacgccgccgaccccgccggccgcaccgtgccctacgtcgccgtcgtgtacgagcaggtctggacccgcacccgccagctcgcctctttcacccgggtgccccgcgcccactgaaaccatacgccacacggtggggccgaagcgaccgtcctccgtcaattacgtggccaagcaaaacctaaataatgggttcaataaataaaaaaaagggcttccccctggttccaagggacctataagaagatactaataatggtcgcaaggaaccaaaaaaacctgggtttttccttatccggggaaaaaaaaaaaccccttt

SEQ ID NO: 40240 - protein, 129 aa, Zea mays
  misc_feature: Ceres CLONE 1432501-F
  misc_feature (81)..(81): Xaa is any aa, unknown, or other
MATHRHCLPLLLLVAAALAAVPARAALGGGRGPLLGGWNPIPDVSDSHIQELGGWALGQAKHQKLAADGLRFRRVVRGEQXVVSGMNYRLYVDAADPAGRTVPYVAVVYEQVWTRTRQLASFTRVPRAH

SEQ ID NO: 40241 - DNA, 748 bp, Zea mays
  misc_feature: Ceres CLONE 1432502-F
  misc_feature: Encodes the peptide sequence at SEQ ID NO. 40242
ctccccgcggtggcggccgctctagaactagtggatcccccgggctgcaggaattcgcacgagaccattacctagaacatcctaatcgaaaagacggcctccacctccgtcttgaggcgaagcgtagtgcgaaggaccaactctttcgaagggaaattatatctcaggtgcttaggagtctgccatggccagcgagaataaggtatttaggttcgaggaagtcgccaagcacaacgtcaccaaggactgctggatcatcatcgccggcaaggtgtatgatgtcactccttttatggatgagcatcctggtggagatgaggttttgctagctgtaactgggaaagatgctacagctgattttgaagatattggccacagtgattccgcaagggacatgatgggagaactaccacatccgggcggatagatgctttcaccaatccccgccaaacgaacttttgttgcacccccagcaagcgcccagccactcaaaaaaaaaaaatggattcctccacaaaaatcccgcagtcccttgtgccccattaagacccgggggccttgcttttggaataccgtcggcaccccaaaacaaaaagaaaccttttcctagaaaactgcccttttggagcccttttttatggaaagggttttggaaaaaaaaaccccccaaaaattcctttaagggatttgtccgcggggggggtgatccttccgtgggcctacacctttttgtttatggcaccccccc

SEQ ID NO: 40242 - protein, 80 aa, Zea mays
  misc_feature: Ceres CLONE 1432502-F
  misc_feature (7)..(76): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MASENKVFRFEEVAKHNVTKDCWIIIAGKVYDVTPFMDEHPGGDEVLLAVTGKDATADFEDIGHSDSARDMMGELPHPGG

SEQ ID NO: 40243 - DNA, 690 bp, Zea mays
  misc_feature: Ceres CLONE 1432503-F
  misc_feature: Encodes the peptide sequence at SEQ ID NO. 40244
tcttcactagtggatcccccgggctgcatgtattcgcacgagaccattacctagaacatcctaatcgaaaaaattcggatccgcctccatggctgccgcttcgcagctcctctctctgttcttcctcctcctcctccctgcttgtgatgccatctactgcgacgaagacgactgctacgacctcctaggggttaagcaggacgcgaacgcgtcagacatccagaaagcgtactacaagctctctctcaaacaccacccggacaagaatcccgatccggagtcgcggaagctcttcgtcaagatcgccaatgcttacgagattctgaaggatgaatccactagggcgcagtatgactttgccattgaacatccggaggaggttccctataacaccagttcagtactatagggtatactatggacataaaacggatcctcgtgcaccgttgattggtcttcttccaattcgcccagcatttcaatacattaatgcccttcaccacgtataaccccgtccatgaaaagtgtgcagcaaacctcctgcttacaaaaatcacctaaacgctcttggattccttacgcccaggatcgaattgctaggcaaatcaaatgggcctccattcacgtggcatacgaacagctgaaccaatgaccctattaatgtaattccatttgccccattcctcggcg

SEQ ID NO: 40244 - protein, 106 aa, Zea mays
  misc_feature: Ceres CLONE 1432503-F
  misc_feature (28)..(89): Pfam Name: DnaJ Pfam Description: DnaJ domain
MAAASQLLSLFFLLLLPACDAIYCDEDDCYDLLGVKQDANASDIQKAYYKLSLKHHPDKNPDPESRKLFVKIANAYEILKDESTRAQYDFAIEHPEEVPYNTSSVL

SEQ ID NO: 40245 - DNA, 699 bp, Zea mays
  misc_feature: Ceres CLONE 1432506
  misc_feature: Encodes the peptide sequence at SEQ ID NO. 40246
ccctggctctagctctccaagccgatgctgctcgctacccctctccaagctgacgccccaaccatggcactctctgctcctccaagccggcgacccctcctctctggttcagcgcaggggactccctccatggctggcgcccctgatggccggacctccacctcgccattgccggttgctcctgcactagattatcttcaagcccggtcgcggtatagcagcaacaaccatgaaaccccatcgtgtcgcgccctcgacgtgttcgacagaatatcgcagcaagcagtgccctccccttttctgcagcaagtggatgcccccagcccctcccttgttcccatggccgaccacctgctgctcccatggtgatttctaaatccctttgttgttttactagttcttattaataccctgctgatgtgaggttttatgtgtgttgatgtgtgcgatatggagtaaaatccttggagaattaggtggagaagaaggttaagttcaacgctccttaggtgttcgatggtatgctcgaactggtggccgtcttcgttcttgctgaaatcgagtcggagcatgatgtgatgagccaagtcatttctccgactacttagttaatgaatgatttggttatataattawtgttgtaatggtatttgatgtgatgaaatgttttagttgtgtgcgaaaaaaaaacaaaaaaaa

SEQ ID NO: 40246 - protein, 114 aa, Zea mays
  misc_feature: Ceres CLONE 1432506
MLLATPLQADAPTMALSAPPSRRPLLSGSAQGTPSMAGAPDGRTSTSPLPVAPALDYLQARSRYSSNNHETPSCRALDVFDRISQQAVPSPFLQQVDAPSPSLVPMADHLLLPW

SEQ ID NO: 40247 - DNA, 624 bp, Zea mays
  misc_feature: Ceres CLONE 1432508-F
  misc_feature: Encodes the peptide sequence at SEQ ID NO. 40248
  misc_feature (301)..(301): n is a, c, t, g, unknown, or other
  misc_feature (329)..(329): n is a, c, t, g, unknown, or other
ccccgcggtggcggccgctctagaactagtggatcccccgggctgcaggaattcgcacgagaccattacctagaacatcctaatcgaaaattttccgattgcgatcccatcaacggccgccggaccgccgctgggttttctttttttctcgcccaagccgcggcgccggcggggtcctttgtaaaggcctcgcggaacgggagcggcctgctctccctctctctggattaaacgaagcatcctccctgtttggatcggcatggagaagacgacgacgacagcgcagccggtttgcgcgcangagtcgctggcgctgctcaactgcgtcncactcgtcctctacgaccgggataggtgccctcgcctcgtcgacaacctccgtgaatgcatcgtgcgcaagagggatgaagaatttttcgctagcagatcaagctccaccacaaccaccgagctcttgagagcgatacgaaacccttgacattcttgcaagaaacttccctttatgtttcgaaactggaccatctgaatgggccccgttgaagaaaaaacccagcgctgttaagggagcggtaaaatttggactttttgaaccatgcccaaaatgacttgggcccaaaatacccc

SEQ ID NO: 40248 - protein, 72 aa, Zea mays
  misc_feature: Ceres CLONE 1432508-F
  misc_feature (14)..(14): Xaa is any aa, unknown, or other
  misc_feature (24)..(24): Xaa is any aa, unknown, or other
MEKTTTTAQPVCAXESLALLNCVXLVLYDRDRCPRLVDNLRECIVRKRDEEFFASRSSSTTTTELLRAIRNP

SEQ ID NO: 40249 - DNA, 717 bp, Zea mays
  misc_feature: Ceres CLONE 1432510-F
  misc_feature: Encodes the peptide sequence at SEQ ID NO. 40250
  misc_feature (398)..(398): n is a, c, t, g, unknown, or other
  misc_feature (471)..(471): n is a, c, t, g, unknown, or other
  misc_feature (514)..(514): n is a, c, t, g, unknown, or other
ctccccgcggtggcggccgctctagaactagtggatcccccgggctgcaggaattcgcacgagaccattacctagaacatcctaatcgaaaaaagacgtacaagcacacggccaccgaaccaagcaagcagcatcggaccagcgggcgcatcgatcgagccagtactcctcgaccggcccggccatagaagcataataacactacagggggtgtggagcggagaggtagatggcgagcgggagcggcaaggcgaaggcgtcgtcgtgggcggcggcgatgagcgtcggcaccgtggaggcgctcaaggaccaggccggcctgtgccgctggaactacgcgttccggcaggcggcgcagcagcgcgccaggaggccagcggcaggcgcgagcggctcantcggccctggcagctgcagcggcagcgcgcacgcgccgtctgcttctgctccctcgggctgccccccggcggncaagaagaaaaccaggcaccagcaggagggagagctccggacngtcatgtacctcaccaactggggtccaacacctaggggttccaaacttccctaatcgggggaatccccgagcagggaaaacaaattggggaggggcgggaaaaaattgaaaagggaagacctttggggaaacccccatctttgttgaaaaaaaaaaaaaatttaaaggccctttttttggggaaaatttttattttttctttt

SEQ ID NO: 40250 - protein, 112 aa, Zea mays
  misc_feature: Ceres CLONE 1432510-F
  misc_feature (57)..(57): Xaa is any aa, unknown, or other
  misc_feature (81)..(81): Xaa is any aa, unknown, or other
MASGSGKAKASSWAAAMSVGTVEALKDQAGLCRWNYAFRQAAQQRARRPAAGASGSXGPGSCSGSAHAPSASAPSGCPPAXKKKTRHQQEGELRTVMYLTNWGPTPRGSKLP

SEQ ID NO: 40251 - DNA, 734 bp, Zea mays
  misc_feature: Ceres CLONE 1432518-F
  misc_feature: Translation starting site: 176
  misc_feature (314)..(314): n is a, c, t, g, unknown, or other
  misc_feature (319)..(319): n is a, c, t, g, unknown, or other
  misc_feature (324)..(324): n is a, c, t, g, unknown, or other
  misc_feature (711)..(711): n is a, c, t, g, unknown, or other
ggagctccccgcggtggcggccgctctagaactagtggatcccccgggctgcaggaattcgcacgagaccattacctagaacatcctaaccgaaaaattttgcatctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccaccacccagactctcatcatgggtgttgcaccatccnagggncgggntcgaggcggcccgccggagctgagaacggcgggtggcagtggcgcgcccactgcacctgcgacccctgccactggaagtgaaacgacggccggcaattaccctgcaggtccttgccccttgcagggcgtgatggggtcctccgaaaggaccttttatcccacctaattaaaaacgcgatctagaaataaaattcccaccggggcccttttgttgggtttttttaaaaacaaaaaaaaaatcccccccggggccagggggcaaggaaaaaaaggggcttgggttaattggcccccttttttttaaaaaaagggtttttttttagggggggcccgcggggggggaaaaaatataattccccccaatttttggcccccccgctggtgggngggggtctcccccccccccccct

SEQ ID NO: 40252 - DNA, 810 bp, Zea mays
  misc_feature: Ceres CLONE 1432522
  misc_feature: Encodes the peptide sequence at SEQ ID NO. 40253
gattcgtctcaaaagcgcttcgtgaactcgcacggtcgcacggcacggggaggagcaagaacacccagcccactgcccacgccgtgctggaagtggcagcggcggcgggaggaagagggaagcgaggggatggcacagccgagcaaggagccgtgcaagaaggaggcgtgcgacatccaggcctgcctctccaagaacatattcgactccaggaagtgtgtgagagttattcagttacttcagtcatgttgtgagcagtgtgagtacaaatcaacacactgtggttccttgtccggattactcaagaacatttctaagtgaggaacaataccgacatagtttactgcagccattgaataaaagttcttgtaggttagtttagtactttatggggctcacggcaatctctcttacggatcaaggatgattcgcggggcttcaataatgcagacacccctcaacctgcagaatgatgctctggtcgctgagttgtatggtaccgagtggaaacagcaaagcggtttgttaatgatcgattttaatgcctgtatacctatggtatccttcgtagttcgtgtgctctaatacacatgtaatcccatgttcgcgtcttgaaccgctaaataagtgaaccccatgcatatggagatattttggtgaccccaaagttgtgtataccatttcattgctttaccctaccatgttctgtggcaagagaaccaaatctgtttaaacatctgggatgataatttatctcttgggcaaaaacttgtgatgtaagatatgattcaaataaaaaaaaaaaaaaaa

SEQ ID NO: 40253 - protein, 63 aa, Zea mays
  misc_feature: Ceres CLONE 1432522
  misc_feature (6)..(63): Pfam Name: DUF1903 Pfam Description: Domain of unknown function (DUF1903)
MAQPSKEPCKKEACDIQACLSKNIFDSRKCVRVIQLLQSCCEQCEYKSTHCGSLSGLLKNISK

SEQ ID NO: 40254 - DNA, 684 bp, Zea mays
  misc_feature: Ceres CLONE 1432524-F
  misc_feature: Encodes the peptide sequence at SEQ ID NO. 40255
  misc_feature (480)..(480): n is a, c, t, g, unknown, or other
  misc_feature (482)..(482): n is a, c, t, g, unknown, or other
  misc_feature (497)..(497): n is a, c, t, g, unknown, or other
  misc_feature (578)..(578): n is a, c, t, g, unknown, or other
  misc_feature (684)..(684): n is a, c, t, g, unknown, or other
tggagctccccgcggtggcggccgctctagaactagtggatcccccgggctgcaggaattcgcacgagaccattacctagaacatcctaatcgaaaaaattcgtttatagcgagcacaccagcgaaccagagattcatcagagtggcgatggccccgagcgcgtcgatgctgttcctgagctaccaccagctccacaggccgacggaggtggggacgccgccgccgccgccgcgcagggaggcggctgcccccggtggcttctggaggaggatgagcgtgagcagcgtgctctcacccgctttgttgcagtggcggccggagggggaggcgacactgcacgagcgcgaccccggcgaggagatcaagtcatcggcgccggccgacgctgataaggagctggaaaagcaagttcgaggaggcgctgcgcctcagctgctggtcttcatgagcatccatccatcatggggaaacgagagacncnagcgtgcccctaaantcaagcgacctctcctctaacaggcgtcctgtatatcttcctccgggtatcaaaatcccatcttttgctttagatttttgnacttttgaatcgtcccatcggctcaatatgtatatatattttagtttggagcaaaaaaaaaaaaaaaagcttatcaataccttcaacctcaggggggccccgtacn

SEQ ID NO: 40255 - protein, 122 aa, Zea mays
  misc_feature: Ceres CLONE 1432524-F
  misc_feature (111)..(111): Xaa is any aa, unknown, or other
  misc_feature (112)..(112): Xaa is any aa, unknown, or other
  misc_feature (117)..(117): Xaa is any aa, unknown, or other
MAPSASMLFLSYHQLHRPTEVGTPPPPPRREAAAPGGFWRRMSVSSVLSPALLQWRPEGEATLHERDPGEEIKSSAPADADKELEKQVRGGAAPQLLVFMSIHPSWGNERXXRAPKXKRPLL

SEQ ID NO: 40256 - DNA, 705 bp, Zea mays
  misc_feature: Ceres CLONE 1432529-F
  misc_feature: Encodes the peptide sequence at SEQ ID NO. 40257
  misc_feature (608)..(608): n is a, c, t, g, unknown, or other
  misc_feature (685)..(685): n is a, c, t, g, unknown, or other
  misc_feature (697)..(697): n is a, c, t, g, unknown, or other
ggagctccccgcggtggcggccgctctatatctagtggatcccccgggctgcaggaattcgcacgagaccattacctagaacatcctaatcgaaaaactagcagccctcggtcgcattctcttcctctcctagagtcctagtccttcccatcccaggtcacccagagagcgagaagccgagaaggtgagtgagactacgcccacgcgcccacggggacgggccagcgccctagctagctctcggccgcatcgccggacgtctattaaaccgccgccgctcgtcctcggcatgcgcggctctgctcgccagcgagatggcgcctgcagcttcgatcctctcggccaccgccgccgcctccgccaagcgcccgcccacttccgacgctgatgagctcccgcacgactcctccgcgccccaccagcaggtgcaggtcgacgagcccgcgcgcaagggccagcaaccgcggcagcagcagcttgagtgcccgcgctgccgctccaccaacaccaagttctgctactacaacaactacagcacggcgcagccgcgccacttctgccgcgcgtgccgccgctactggacgcacgggggcacgctgcgcgacgtncccgtcgggggcgcctcgcgccgcgcccgcactggcggcggcggcaagcggcgcagggtctccgccgagccctcatncccgccgcgtcngtcgcgga

SEQ ID NO: 40257 - protein, 130 aa, Zea mays
  misc_feature: Ceres CLONE 1432529-F
  misc_feature (50)..(112): Pfam Name: zf-Dof Pfam Description: Dof domain, zinc finger
  misc_feature (124)..(124): Xaa is any aa, unknown, or other
  misc_feature (128)..(128): Xaa is any aa, unknown, or other
MAPAASILSATAAASAKRPPTSDADELPHDSSAPHQQVQVDEPARKGQQPRQQQLECPRCRSTNTKFCYYNNYSTAQPRHFCRACRRYWTHGGTLRDVPVGGASRRARTGGGGKRRRVSAEPSXPPRXSR

SEQ ID NO: 40258 - DNA, 711 bp, Zea mays
  misc_feature: Ceres CLONE 1432545-F
  misc_feature: Encodes the peptide sequence at SEQ ID NO. 40259
  misc_feature (295)..(295): n is a, c, t, g, unknown, or other
gctctagaactagtggatcccccgggctgcaggaattcgcacgagaccattacctagaacatcctaatcgaaaactataacaggatcaagagcttggtgaccgaggagttgaagcagtatttccggccagagttcttgaacagattggatgagatgattgtgttccggcagctgacaaagctggaggtgaaagagatcgctgatattatgctcaaggaggtgtttgacaggctcaaggcaaaggaaatcgacctcccaggtacagagaagtccggggatagggttgtcgatgaangtttacacccgagctacggtgccaggccctctgcgacgtgccattatgaggctttttggaagacagtctggcggaaaagatgctggcttgcaaggtcaaggaaggggattctgctatggtgatggggattcgaagggaaggggggaattcccaccaccggggtggttattcaaacccctgaaccctttctaaagccctattgggaaacccccttttttatttcttttcccccccttgggccccgggggggcccccaaaaaaaaaccccgccccctcccaaaaggggcccccccccccttttttggccccccccccccccccccccccggagccccaatttttggcgccggccccaaaatttgttttttaaaacaaaaacaactatatttttgtttcaaaacccttttttctccaaa

SEQ ID NO: 40259 - protein, 87 aa, Zea mays
  misc_feature: Ceres CLONE 1432545-F
  misc_feature (48)..(48): Xaa is any aa, unknown, or other
MIVFRQLTKLEVKEIADIMLKEVFDRLKAKEIDLPGTEKSGDRVVDEXLHPSYGARPSATCHYEAFWKTVWRKRCWLARSRKGILLW

SEQ ID NO: 40260 - DNA, 723 bp, Zea mays
  misc_feature: Ceres CLONE 1432548-F
  misc_feature: Encodes the peptide sequence at SEQ ID NO. 40261
  misc_feature (316)..(316): n is a, c, t, g, unknown, or other
  misc_feature (317)..(317): n is a, c, t, g, unknown, or other
  misc_feature (455)..(455): n is a, c, t, g, unknown, or other
ggagctccccgcggtggcggccgctctagaactagtggatcccccgggctgcaggaattcgcacgagaccattacctagaacatcctaatcgaaaaacctgagaaatggcggccgtctcctccacctccaccgcctcctcctacttctcctcgcagccgcagctgccgatctccaccgccgaccctgccgccagcaaaagtaggttgatgcggcagccacggcggagcagcagcttcgtgatgatggaggcgtcctctgccagcggcagcaacggcggggtggccaggacgaagagcctcacggaggacgacctgnnagagctcaagggctgcctcgacctcggcttcggattcgcgtacagcgagatacccgagctctgcgggacgctgcccgcgctcgaactctgctactccatgaccctggagttcctcgacaagcaaaaggcgtcggggtncagagaggagtttgaaccttgcgtccccgccccttcccaattgaaggatcccggcccccggtgaccatcccaaaaaaattaaaggcgaggttgaaattttggcctcaagttttggattggccttgaaactcttgccctaaaataaaaggcccgaaaagggctaaaaaactcggttattttgtttttgaaaaaaagaaaccaaaagggggtttttttcctccttggagggaaacaaaaagggaattctcccttcctccaaaaagaaagg

SEQ ID NO: 40261 - protein, 137 aa, Zea mays
  misc_feature: Ceres CLONE 1432548-F
  misc_feature (11)..(129): Pfam Name: DUF1685 Pfam Description: Protein of unknown function (DUF1685)
  misc_feature (71)..(71): Xaa is any aa, unknown, or other
  misc_feature (117)..(117): Xaa is any aa, unknown, or other
MAAVSSTSTASSYFSSQPQLPISTADPAASKSRLMRQPRRSSSFVMMEASSASGSNGGVARTKSLTEDDLXELKGCLDLGFGFAYSEIPELCGTLPALELCYSMTLEFLDKQKASGXREEFEPCVPAPSQLKDPGPR

SEQ ID NO: 40262 - DNA, 721 bp, Zea mays
  misc_feature: Ceres CLONE 1432563-F
  misc_feature: Encodes the peptide sequence at SEQ ID NO. 40263
  misc_feature (349)..(349): n is a, c, t, g, unknown, or other
  misc_feature (358)..(358): n is a, c, t, g, unknown, or other
  misc_feature (417)..(417): n is a, c, t, g, unknown, or other
  misc_feature (436)..(436): n is a, c, t, g, unknown, or other
  misc_feature (477)..(477): n is a, c, t, g, unknown, or other
  misc_feature (511)..(511): n is a, c, t, g, unknown, or other
  misc_feature (534)..(534): n is a, c, t, g, unknown, or other
aagctggagctccccgcggtggcggccgctctagaactagtggatcccccgggctgcaggaattcgcacgagaccattacctagaacatcctaatcgaaaaatcaaaaacatctccaaaaccccattccgcaatgagacccgcagccgcagcagccaccgctaccaccgccgcgctccgtctccgcgccgcctccctctcgccttctctcgctgcctccctttcgccttctctcgccgccctcctttctcatcgtagatcctccctcattcttcctccgctgcgccgcatctgctcccttgcgcctccccactcctccgccgcccccaattcgcagctcccgccgcagntgctctctnccatcatggacgcgcagttcgagctcttccgcgcgcagctcgacgagtcttccaccctnccgcgacgcatcccgtgcngtcgtcgccgagatttgagtccgctcccggggtgccaccgncggggtttctctaagtcaccagccggtcccctgncaaatgggctttggaaaagcaangcccaggtaaaagtgatccaggggttgtaccccgcccctggcgaagtccctaagggatgccctggggaggaactccggtacctttgtaaatgggaggatgaaacccaaatgggaggggccaaagtttgcattatggcatggggggagaaagggggccaatcttgggtgttgaacccccaaaaaaatg

SEQ ID NO: 40263 - protein, 119 aa, Zea mays
  misc_feature: Ceres CLONE 1432563-F
  misc_feature (25)..(25): Xaa is any aa, unknown, or other
  misc_feature (50)..(50): Xaa is any aa, unknown, or other
  misc_feature (57)..(57): Xaa is any aa, unknown, or other
MDAQFELFRAQLDESSTLPRRIPCXRRRDLSPLPGCHRRGFSKSPAGPLXNGLWKSXAQVKVIQGLYPAPGEVPKGCPGEELRYLCKWEDETQMGGAKVCIMAWGEKGGQSWVLNPQKN

SEQ ID NO: 40264 - DNA, 685 bp, Zea mays
  misc_feature: Ceres CLONE 1432567-F
  misc_feature: Encodes the peptide sequence at SEQ ID NO. 40265
  misc_feature (333)..(333): n is a, c, t, g, unknown, or other
  misc_feature (385)..(385): n is a, c, t, g, unknown, or other
  misc_feature (445)..(445): n is a, c, t, g, unknown, or other
  misc_feature (453)..(453): n is a, c, t, g, unknown, or other
  misc_feature (454)..(454): n is a, c, t, g, unknown, or other
  misc_feature (500)..(500): n is a, c, t, g, unknown, or other
  misc_feature (501)..(501): n is a, c, t, g, unknown, or other
  misc_feature (524)..(524): n is a, c, t, g, unknown, or other
  misc_feature (545)..(545): n is a, c, t, g, unknown, or other
  misc_feature (583)..(583): n is a, c, t, g, unknown, or other
  misc_feature (592)..(592): n is a, c, t, g, unknown, or other
  misc_feature (608)..(608): n is a, c, t, g, unknown, or other
gcaggatttcgcacgagaccattacctagaacatcctaatcgaaaaagaagacttcacaagaatctactcgctcagtcaccaatgataaggctctatcggactccgagtctcggacagcacagtaaagcaagagccgctactcaagtatagtctgacaccggccgaccctgccccaacccaagccatggcggacaacaacaaccggcggaaccacgggcagaccttgctcgccggctcgggcctgggcctgctcgccgtgaactcgggcctcgccattctaccgcgcgaggggcgacacgggcgccggtctcttcttcgccggggcctagggngaccctggcacctcctcttcgcttgcctcccccccctacaaagcgggcggcnccccgggtcctccggccggggaaccgggccgcgcagcgccgtggggcccgtttctcccgncttgttcnncctcccggttacccctggaaagggtggggggggggccatgcctttnngtccgccgggcgccccccctttnattggggccctgtctctgggncccccaatcactcgggcgggtttcccgacgccggggtngttggaacnagggctttgaaccccngggcgcctcgtcccccacttcccaaatccaattttgcaaaattgtaaacgccacctacgggagacctacaccccgcc

SEQ ID NO: 40265 - protein, 138 aa, Zea mays
  misc_feature: Ceres CLONE 1432567-F
  misc_feature (50)..(50): Xaa is any aa, unknown, or other
  misc_feature (67)..(67): Xaa is any aa, unknown, or other
  misc_feature (87)..(87): Xaa is any aa, unknown, or other
  misc_feature (90)..(90): Xaa is any aa, unknown, or other
  misc_feature (105)..(105): Xaa is any aa, unknown, or other
  misc_feature (106)..(106): Xaa is any aa, unknown, or other
  misc_feature (113)..(113): Xaa is any aa, unknown, or other
  misc_feature (133)..(133): Xaa is any aa, unknown, or other
  misc_feature (136)..(136): Xaa is any aa, unknown, or other
MADNNNRRNHGQTLLAGSGLGLLAVNSGLAILPREGRHGRRSLLRRGLGXPWHLLFACLPPLQSGRXPGSSGRGTGPRSAVGPVSPXLFXLPVTPGKGGGGAMPXXPPGAPPXIGALSLGPPITRAGFPTPGXLEXGL

SEQ ID NO: 40266 - DNA, 794 bp, Zea mays
  misc_feature: Ceres CLONE 1432568-F
  misc_feature: Encodes the peptide sequence at SEQ ID NO. 40267
cctggagctccccgcggtggcggccgctctatactagtggatcccccgggctgcaggaattcgcacgagaccattacctagaacatcctaatcgaaaaccctgtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttcctcgtcggcaggattgctaggttcctcaaggcgggcaagtacgctgagcgcgtcggctccggcgcccccgtgtaccttcgcgccgtcctcgagtacctcgcggctgagggtctcgaacctgccgggaaccccgcggagggacaacaaaaaaaccccccattggccccgccccccccccactttgttttgccccacgaccaagaaacttcccaaactgtttggggggggcccccctccccggagggggaggtgttttagcctaaaattccaataaaattttggctccccaaaaagggttccctcccctccaggggccgtgttgcacaaaaaaaccaaccctttgaaattgtttcccctacaaaaaaaatctccacaccccccttttttttttaaaaaaataaaaaaaaagtttctccctcccgcgggggaaaaattgtctttttttttggaaaagaacataaaaaaaaattttcctttttttttggagaggagaaaacacaccaccttcaaaaaaccagaagatgtcccccccccacaaaaaaaagaaaagag

SEQ ID NO: 40267 - protein, 112 aa, Zea mays
  misc_feature: Ceres CLONE 1432568-F
  misc_feature (19)..(93): Pfam Name: Histone Pfam Description: Core histone H2A/H2B/H3/H4
MAGRGKAIGAGAAKKATSRSSKAGLQFLVGRIARFLKAGKYAERVGSGAPVYLRAVLEYLAAEGLEPAGNPAEGQQKNPPLAPPPPHFVLPHDQETSQTVWGGPPSPEGEVF

SEQ ID NO: 40268 - DNA, 691 bp, Zea mays
  misc_feature: Ceres CLONE 1432572-F
  misc_feature: Encodes the peptide sequence at SEQ ID NO. 40269
  misc_feature (406)..(406): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (587)..(587): n is a, c, t, g, unknown, or other
  misc_feature (588)..(588): n is a, c, t, g, unknown, or other
  misc_feature (591)..(591): n is a, c, t, g, unknown, or other
tccccgcggtggcggccgctctagaactagtggatcccccgggctgcaggaattcgcacgagaccattaccagaacattcctaatcgaaaaaccctttgccatttgcttgcaatgtctaatacctgagtgagagagcttcctcagtccatggaggtgtcgtcgaggctccaaagcctcctcagacccttcctactctgccgctcccgcgccgcagggatgaccctccaaaccctagctctttgctccccgccgcctcctccgcgcatcccatcttccttcctcctccgaacgcgccgtctacctcctccctttccccatggcggcccatcccgtcttcttttccacagcaccttcgcctccgtctccccggcccccgcccctgcttcaggggagggaccacctcanctcccagggaacgggacccccccgcccggggcctttgggttcccgcaccgcccgaagaaaacttcccctccctcaaaaaaagatcttttttcccccaaggactttttttttaaaagggggccgggagaaacacttcccgggggggctccccccnnnaagggggttttttttttttgccccnnttncccggggggggcgggggccccaaaatttcttttggtggttccccccaccttggggggccccaaaataatttggtctttaaaaaccccaagggcgggggga

SEQ ID NO: 40269 - protein, 113 aa, Zea mays
  misc_feature: Ceres CLONE 1432572-F
  misc_feature (30)..(30): Xaa is any aa, unknown, or other
  misc_feature (82)..(82): Xaa is any aa, unknown, or other
  misc_feature (91)..(91): Xaa is any aa, unknown, or other
  misc_feature (92)..(92): Xaa is any aa, unknown, or other
MAAHPVFFSTAPSPPSPRPPPLLQGRDHLXSQGTGPPRPGPLGSRTARRKLPLPQKKIFFPPRTFFLKGGREKHFPGGLPPXRGFFFFAPXXRGGRGPQNFFWWFPPPWGAPK

SEQ ID NO: 40270 - DNA, 715 bp, Zea mays
  misc_feature: Ceres CLONE 1432580-F
  misc_feature: Encodes the peptide sequence at SEQ ID NO. 40271
  misc_feature (360)..(360): n is a, c, t, g, unknown, or other
tccccgcggtggcggccgctctagaactagtggatcccccgggctgcaggaattcgcacgagaccattacctagaacatcctaatcgaaaaaccgttcttgccgttgcgaaccctctcctcctctcaggccaggccaccaagcaacaagatgccaagcgacgaccaccatcgccgccggacgttcttgctcccggtctactgcccaagcttctcggccaccggggcccccgcgtcaccgccggctgccgcagcctcgacggggcgcctctgctgctggatgaccaggaagaagaggaagcggctcaagcaccgccgtgcgagcaccagcggctgctgggagcgcttccgtgctcatgctngtctgtgatacggcgctatcctcgccgagcttattcctcgacttccaacctatttcacaccgctgtcagaacccttcttgtgacaaaagttaagcgagcgtcttcttgaccttgcagacttttttgtccgaaaatatctcccaacgattcccctcttgatcttggaaaaaccttcccccgttcggggccggggaatccttccatccctttcggccccggtaatcccttttggagttggaaaactcctcccccctaaaaaagcctaaatttatttgtttccctttcccccattttccagaaaaaacctttggttttttgggaaaaaaaaaaaaattttcgcgggggtttgtttttt

SEQ ID NO: 40271 - protein, 72 aa, Zea mays
  misc_feature: Ceres CLONE 1432580-F
  misc_feature (71)..(71): Xaa is any aa, unknown, or other
MPSDDHHRRRTFLLPVYCPSFSATGAPASPPAAAASTGRLCCWMTRKKRKRLKHRRASTSGCWERFRAHAXL

SEQ ID NO: 40272 - DNA, 731 bp, Zea mays
  misc_feature: Ceres CLONE 1432582-F
  misc_feature: Encodes the peptide sequence at SEQ ID NO. 40273
  misc_feature (299)..(299): n is a, c, t, g, unknown, or other
  misc_feature (347)..(347): n is a, c, t, g, unknown, or other
  misc_feature (381)..(381): n is a, c, t, g, unknown, or other
  misc_feature (390)..(390): n is a, c, t, g, unknown, or other
tccccgcggtggcggccgctctagaactagtggatcccccgggctgcaggaattcgcacgagaccattacctagaacatcctaatcgaaaacaattccaaaacctagactagaggttggcggcgatgacaggttgacagctccagccggcagacagccaggcagccagccacgagcccacgacgaccctccgccggacttgacgacgggtgactgactgcatggcatctgcaagtggcagtgggtgcgcaagcactggagcatcccttggtgctgcgaacaccctgactgtggctgtgncagaaaacactccagttaatggagatggagaaggagaagatggaaaangacaactgatattggagtgaaagagtctgatccnagaaaaggnaacccaaaagacaacctctgggggttgggactactttatcaagtccctgggacaaaaaagggaataaaggggaactaagaaacaatttgggcaaatggaaaaaggcaattccaaacccgggggaacccccaaaaaaggtaaaacttgggtttccaaattttgggcccgggggggcgcggcccctttaccctaggggaaaaagcacagggttttcctttggggagggggggccttgtgggtcttttggccccccgggggggggggggccccccacaaattttgggccgcggggggggggggggccctttttttggggggggggccccccaaaaatatttttt

SEQ ID NO: 40273 - protein, 48 aa, Zea mays
  misc_feature: Ceres CLONE 1432582-F
  misc_feature (27)..(27): Xaa is any aa, unknown, or other
  misc_feature (43)..(43): Xaa is any aa, unknown, or other
MASASGSGCASTGASLGAANTLTVAVXENTPVNGDGEGEDGKXQLILE

SEQ ID NO: 40274 - DNA, 823 bp, Zea mays
  misc_feature: Ceres CLONE 1432583-F
ctccccgcggtggcggccgctctagaactagtggatcccccgggctgcaggaattcgcacgagaccattacctagaacatcctaatcgaaaactctctctcttgattcctttcccgaggagctcagctcgctcggctagctaggcaccgggttcctgttcctgccgcgaggcgcgtctcacacgcggcggtcggtgcgcgcatgcagcagcgggcccacgacgcggcgggcgccaacgcctgaatgacggtgccgcgtttcgggactgggacaccaagaaacggccgctgccgggactactccatggacttctccaaaatccccaagaatgcccaagcaaaacaaaaaaggacctcccccccccccggcccgggggggaaaaaaaaaactccttcccccacccccaggcccagggcccttgaaaacccaggggcaaaaaccccccccccaaaaattggggccccccccccccgggccccccaaaaaaaaaccccccccaaggggaggggaaaaacctctcccagcccctcctcgggggtgtaaaacgagccaagaaaagaggggcttttttagggcgcgccccccccttttgttttttttctcctcacaaaaacaatttttgggacaacccccccccctttttttttttacaaccccccccccccccaaaaaaaaaaataaatatttcttttttctaataaaaaacgccccgcggggcaggaaaaaaaaaaacaacacttgtgtgggggggagaacttttttttttttattaaacaaaccacaccccctttttttttttttttaaaaaaagggggggtgggga

SEQ ID NO: 40275 - DNA, 752 bp, Zea mays
  misc_feature: Ceres CLONE 1432584-F
  misc_feature: Pfam Name: DUF260 Pfam Description: Protein of unknown function DUF260
ggagctccccgcggtggcggccgctctagaactagtggatcccccgggctgcaggaattcgcacgagaccattacctagaacatcctaatcgaaaaacaacttgggcgcggccggattcgtataggttagcagcacacagtagcaagctcgcgatctgtgcgcccaccatcaccaccaccgccgggaggagaggaccgaccgaccgaccgaagatgcggatgagctgcaacggctgctgcgtcctgcgcaagggctgcagcgacgcctgcaccatccgcccctgactgcagtgaatcgacagccgcgaggcgcaggcaaacgccaccgtcttcgtcggcagattctacggacgacgcgggatgctacaactgctgggcggcgcgcccggagagggctccccgcccggccagttttccgctaccatggtgtaagagggggggagggccaaattgggaaacccccctctaaggttccctttggccttgtttaggccagccggggggaaaaaacctcctccaaccaccttaaaggccgttttctcggggggaaaccccccctttaatgtttaaccccgggttcaaaaaccccccccccaccccctatccctttttttttccgagaaaaggaaaccccgcccccccgcgccccaaaaaattttcccgggaaaaaaaaggaatacaaagaggggcggggggcccaaaaacccctccgggggggagaaggagggggccctaatatttatttccccccc

SEQ ID NO: 40276 - DNA, 700 bp, Zea mays
  misc_feature: Ceres CLONE 1432594-F
  misc_feature (231)..(231): n is a, c, t, g, unknown, or other
  misc_feature (260)..(260): n is a, c, t, g, unknown, or other
  misc_feature (273)..(273): n is a, c, t, g, unknown, or other
ctccccgcggtggcggccgctctagaactagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcntctcgttcgggtgcccatgctgctgctgntccctggcgtgcntgtgtcctgctccttcgcggcgggcagcttggaccagagctggacatcaccgtgggcgacgggcggggcaggtcctgaacacggggcgctgctgacttttccctgaacccacttccggtcccgtttcattcccggcaaaattacctgttcgaaaaaacaaattgagttgggttggggccgggaaatcccccgggccccaccccccaaaaatttgtgttaaagggggcccccaaaaaaaaatcttttattttcgggaaaaaggtccgggaacccaccccttaccacaaattttttcccgggggggggggagggagaaaatatttccccttgttttccccccccccaaaattccaccttctctttttagaaacccagagggggggggggccccccggggggtcttttttctcttttaataatcgcgcgt

SEQ ID NO: 40277 - DNA, 709 bp, Zea mays
  misc_feature: Ceres CLONE 1432596-F
  misc_feature: Encodes the peptide sequence at SEQ ID NO. 40278
ggagctccccgcggtggcggccgctctagaactagtggatcccccgggctgcaggaattcgcacgagaccattacctagaacatcctaatcgaaaattttttttgcagttgcagacttgcaggtaagcaagcagaacagagtggcatggcacatctctcaagtcccaactgactgcctgccatggtagtgtagtgtctgagttctgaacagagcaggcgcaggagaagtgaaacatttgttcacttgtgcagcccaggtgcatgttgtccagagataagcaggtgatggctgcgccgatggccgcggcggacggcgggctgaggcggctgttcgagaagccgcttccggagaacccgacgctgctggaggcgctctcggcgtggaaccgcaacgtgcaccaccccagcagcaagcccatcgacacggcgtccttcacggagatcttcggcgagctccacttccaggagaagcagcagcccgaccgaggcgccctcctgccgccgtcgccgtcgcccccgccgacgccgctccctccttcccgcacgctgtcgtggctcgacatcgcggccgaggccgagaaagcaaggacgactcgtcgctggacgcgctgctgaggcccaagccagcgaccaccgtggccacggtgaagaggagcgcgagcttctgcaccaagaagggctcctccgcgtcgctgctgctctgcaccga

SEQ ID NO: 40278 - protein, 117 aa, Zea mays
  misc_feature: Ceres CLONE 1432596-F
MLSRDKQVMAAPMAAADGGLRRLFEKPLPENPTLLEALSAWNRNVHHPSSKPIDTASFTEIFGELHFQEKQQPDRGALLPPSPSPPPTPLPPSRTLSWLDIAAEAEKARTTRRWTRC

SEQ ID NO: 40279 - DNA, 725 bp, Zea mays
  misc_feature: Ceres CLONE 1432601-F
  misc_feature: Encodes the peptide sequence at SEQ ID NO. 40280
tggagctccccgcggtggcggccgctctagaactagtggatcccccgggctgcaggaattcgcacgagaccattacctagaacatcctaatcgaaaaacagcgagtactgagtaggagcaaccgcttgcgtcagacgcacactgacggagagtgatcactgatttctggtcatggcaaccgtaactgaggaagttgctccggtcgtcaccgtttccgaggagccggcgccggaagcggcgaaggaggtggtggagaagccggaggaggggaagaagcccgacgaggagggtgacgagaggaagaaagccgaccccgccgccgaagaagagaagaaggcgaggaacccccggagcaggaagcccaagtccgcccggctgcaccacccgtcctattttcaaatgattcaggaggctatcctttcccaagccgccggaaaggtccgggccaaccccttaccccaaccccaaccactgggggaaaaacccccgggacgtgctcccccccaatttccccaaggggtctgaaagtaaatttgcccggtttcccccccaagggccccccccccaagggaaaaggtttctttaaagccccccctcccaaaaaaaaaaaatccccccccccgcccccaaaggaaaaaaaaaaacgctcccccggtaaatttgccacaccccaaaggcgcccccccccccccacaaaaaaaaaaaacggggggccctcctctctt

SEQ ID NO: 40280 - protein, 117 aa, Zea mays
  misc_feature: Ceres CLONE 1432601-F
MATVTEEVAPVVTVSEEPAPEAAKEVVEKPEEGKKPDEEGDERKKADPAAEEEKKARNPRSRKPKSARLHHPSYFQMIQEAILSQAAGKVRANPLPQPQPLGEKPPGRAPPQFPQGV

SEQ ID NO: 40281 - DNA, 725 bp, Zea mays
  misc_feature: Ceres CLONE 1432602-F
  misc_feature: Encodes the peptide sequence at SEQ ID NO. 40282
  misc_feature (1)..(1): n is a, c, t, g, unknown, or other
  misc_feature (50)..(50): n is a, c, t, g, unknown, or other
nggagctcaccggcggtggcggctgctctagaactagtgcattctccggnctgcaggtattcgcacgagaccattaactagaacatcctaatcgaaaagttgattaccaaagactagtcctggtgttgccgcttttcactttccccctcccccctctcatcggatcaggacactggaaaggagacgagattcaccggggatggcagagcatgccggggaccaaccccgccgctttgaatatcccgacacagcgcctcgccacgctcggggagtacctctccggctccgcggcccgcggggacgtcgaggcggaggcggacgacgagttcatgatgcacgagttcaaggtgcggcggtgcgcgcgcgcgcggagccacgactggacggcgtgcccctacgcgcacccgggcaaggccgcgcggcgccgggacccgcgccgcgtcgcctacgcgggggagccgtgcccggaattccggcccctgccggggggccgccaccgccgcgtgcccgcgcgggggccgcctgccggctcggggcaggcaaccttcaagcttgggggttccaccggtcccgataacggcacccgccccttgccgggcggggggccggcatggcgcccgccgcggtctgtttttttggagaaaggccgagaggcagaagatcagaggcgccacccgagaatcccaagggcgcgggaggctctccggtatttaggattttggctt

SEQ ID NO: 40282 - protein, 172 aa, Zea mays
  misc_feature: Ceres CLONE 1432602-F
MPGTNPAALNIPTQRLATLGEYLSGSAARGDVEAEADDEFMMHEFKVRRCARARSHDWTACPYAHPGKAARRRDPRRVAYAGEPCPEFRPLPGGRHRRVPARGPPAGSGQATFKLGGSTGPDNGTRPLPGGGPAWRPPRSVFLEKGREAEDQRRHPRIPRAREALRYLGFWL

SEQ ID NO: 40283 - DNA, 719 bp, Zea mays
  misc_feature: Ceres CLONE 1432603-F
  misc_feature: Encodes the peptide sequence at SEQ ID NO. 40284
  misc_feature (343)..(343): n is a, c, t, g, unknown, or other
  misc_feature (352)..(352): n is a, c, t, g, unknown, or other
  misc_feature (388)..(388): n is a, c, t, g, unknown, or other
  misc_feature (432)..(432): n is a, c, t, g, unknown, or other
  misc_feature (452)..(452): n is a, c, t, g, unknown, or other
ggagctccccgcggtggcggccgctctagaactagtggatcccccgggctgcaggaattcgcacgagaccattacctagaacatcctaatcgaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggctgccgccngagctgagnaacgcgggtgcaagtgcggcggcaactgccagtgcnacccctgcaactgcggcaagtgagctaggtgctccaccttgcangccggcccggaggaacctancttaatattttaacctaaattaagttttcccgccttcccttgttgtgtttccagtccaccagccattaaattcctgccctggttggaatgccttaaatctaaaaaaataaaaaccctaatgggggcttcggccccgaaaacctcccctgccccccctcggcctttttgggggaaaaaaatgtttttttttttttttttgggggggccccaccaaaaaagggtccccccggggccccctgtggtttggccccccccccaaataaaaaa

SEQ ID NO: 40284 - protein, 82 aa, Zea mays
  misc_feature: Ceres CLONE 1432603-F
  misc_feature (1)..(80): Pfam Name: Metallothio_2 Pfam Description: Metallothionein
  misc_feature (61)..(61): Xaa is any aa, unknown, or other
  misc_feature (64)..(64): Xaa is any aa, unknown, or other
  misc_feature (76)..(76): Xaa is any aa, unknown, or other
MSCCGGNCGCGSGCKCGNGCGGCSKMYPDMAEQVTTTTQALIMGVAPSKGHAEGGFEAAAXAEXRGCKCGGNCQCXPCNCGK

SEQ ID NO: 40285 - DNA, 696 bp, Zea mays
  misc_feature: Ceres CLONE 1432605-F
  misc_feature: Encodes the peptide sequence at SEQ ID NO. 40286
  misc_feature (344)..(344): n is a, c, t, g, unknown, or other
  misc_feature (544)..(544): n is a, c, t, g, unknown, or other
  misc_feature (569)..(569): n is a, c, t, g, unknown, or other
  misc_feature (578)..(578): n is a, c, t, g, unknown, or other
  misc_feature (696)..(696): n is a, c, t, g, unknown, or other
agctccccgcggtggcggccgctctagaactagtggatcccccgggctgcaggaattcgcacgagaccattacctagaacatcctaatcgaaaaaacgacaccatagccctcctagtcccgctcccgcactcctcgtacgtagcgtcacggccgtacgtagaggcgctagcacgtcagagagcgccactggttctgttctgaccgatcggcatggccgggagcgcgaggtcggcggccgcgaagcacgcgtaccggatgttcgcgccgccgtccatgggcgccagcgccggcgccggcgcgggcgttggcggcgcggaggagctcgacgaggcggacgtctggngctcgttcggcgcggcctgccactccagcgccgtgtcgtccgacgacctggccggcgccgccggctgggcgcgcccggtccacggcctccgcgcggggcgaaagaagctcgtggacggcggcggcggctcggtggggtcgctgccgatgaacataccggactggcagaggatcctcggggtcgagtaccgcgaccaccancacgcgggcgagtgggaggccaacncgaacgacngcgggcggcggcggcggcatctacggcggggcggagatggtgccgccgcacaagctggcgtggcccaaccgcgcggcgttccttttcgtgcacgagggggttccggcgaaccctcaan

SEQ ID NO: 40286 - protein, 161 aa, Zea mays
  misc_feature: Ceres CLONE 1432605-F
  misc_feature (34)..(145): Pfam Name: DUF584 Pfam Description: Protein of unknown function, DUF584
  misc_feature (45)..(45): Xaa is any aa, unknown, or other
  misc_feature (111)..(111): Xaa is any aa, unknown, or other
  misc_feature (120)..(120): Xaa is any aa, unknown, or other
  misc_feature (123)..(123): Xaa is any aa, unknown, or other
MAGSARSAAAKHAYRMFAPPSMGASAGAGAGVGGAEELDEADVWXSFGAACHSSAVSSDDLAGAAGWARPVHGLRAGRKKLVDGGGGSVGSLPMNIPDWQRILGVEYRDHXHAGEWEANXNDXGRRRRHLRRGGDGAAAQAGVAQPRGVPFRARGGSGEPS

SEQ ID NO: 40287 - DNA, 716 bp, Zea mays
  misc_feature: Ceres CLONE 1432608-F
  misc_feature: Encodes the peptide sequence at SEQ ID NO. 40288
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (26)..(26): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (125)..(125): n is a, c, t, g, unknown, or other
  misc_feature (485)..(485): n is a, c, t, g, unknown, or other
aaaagggagaanannnnngggcgganggggggnnnnnnnnnnnnaggannnnnnnnnnnnnggggggggggggggggggggnnnccaaagcggggctcaccgcggtggcggggcgcgctgatctngacgggcgcggggggtggaggaattcccacgagaccatgagggagaacatcctaatcgaaaaaacctcgtgttggtcggagcgcacacacacacaaccagatctcccccaaatccacccgtcggcaccgcggggggaagatgcagatctttgtgaaaaccctgactgggaagactatcaccctcgagggggagtcgtctgacaccattgacaacgttaagggcaagatccaggacaaggagggcatccccccagaccagcagcggctcatctttgctggcaaacagcttgaggacgggcgcacgcttgctgactacaacatccataaggagagcaccctggggggtagaggggggctcangggaggcatgcagatctttgtgaaaaccctgaccggcaagactatcaccctcgaggtggagtcctctgacaccattgacaacgtcaaggccaagaaccaggacaaggagggcatccctccagaacagcagcggctcatctttgctgggaagcagcttgaggacgggcgcacgcttgccgactacaacatccagaaagagagcacccctcacttggggctgcgcctcagggg

SEQ ID NO: 40288 - protein, 150 aa, Zea mays
  misc_feature: Ceres CLONE 1432608-F
  misc_feature (82)..(150): Pfam Name: ubiquitin Pfam Description: Ubiquitin family
  misc_feature (6)..(74): Pfam Name: ubiquitin Pfam Description: Ubiquitin family
  misc_feature (74)..(74): Xaa is any aa, unknown, or other
MQIFVKTLTGKTITLEGESSDTIDNVKGKIQDKEGIPPDQQRLIFAGKQLEDGRTLADYNIHKESTLGGRGGLXGGMQIFVKTLTGKTITLEVESSDTIDNVKAKNQDKEGIPPEQQRLIFAGKQLEDGRTLADYNIQKESTPHLGLRLR

SEQ ID NO: 40289 - DNA, 649 bp, Zea mays
  misc_feature: Ceres CLONE 1432611-F
  misc_feature: Encodes the peptide sequence at SEQ ID NO. 40290
  misc_feature (508)..(508): n is a, c, t, g, unknown, or other
  misc_feature (516)..(516): n is a, c, t, g, unknown, or other
  misc_feature (517)..(517): n is a, c, t, g, unknown, or other
  misc_feature (588)..(588): n is a, c, t, g, unknown, or other
aagctggagctccccgcggtggcggccgctctagaactagtggatcccccgggctgcaggaattcgcacgagaccattacctagaacatcctaatcgaaaaaccaaactccagaggcatccaacagcaggcgaggaaagcaagacacgcccacccacccgctccggcagccagcggctatgcagcagcagatgcccatgccgccggcgcccgctgccgccgcggcggcggcgcccccggcggccggcatcactaccgagcagatccagaagtatttggacgaaaataagcaacttattttggccatcctggaaaatcagaacttagggaagttggctgaatgtgctcagtatcaagctcaacttcaaaagaacctcttgtacctggctgcgattgctgatgcccaaccccagcctccgcaaaaccctgcaggtcgccctcagatgatgcagcctggtatagtgcctggtgcggggcattacatgtcacaagtaccaatggtccctccnagaccccnnatacccacagcagatgcaggagcagcagcaacaacacagtttcagcagcagcagcagcaagtgcaggctcntacttttcctggaacgatggtcatgagaccagccaccatcaagggatgcagcacagagcct

SEQ ID NO: 40290 - protein, 157 aa, Zea mays
  misc_feature: Ceres CLONE 1432611-F
  misc_feature (21)..(84): Pfam Name: SSXT Pfam Description: SSXT protein (N-terminal region)
  misc_feature (113)..(113): Xaa is any aa, unknown, or other
  misc_feature (137)..(137): Xaa is any aa, unknown, or other
MQQQMPMPPAPAAAAAAAPPAAGITTEQIQKYLDENKQLILAILENQNLGKLAECAQYQAQLQKNLLYLAAIADAQPQPPQNPAGRPQMMQPGIVPGAGHYMSQVPMVPPRPXIPTADAGAAATTQFQQQQQQVQAXTFPGTMVMRPATIKGCSTEP

SEQ ID NO: 40291 - DNA, 703 bp, Zea mays
  misc_feature: Ceres CLONE 1432616-F
  misc_feature: Encodes the peptide sequence at SEQ ID NO. 40292
  misc_feature (291)..(291): n is a, c, t, g, unknown, or other
  misc_feature (316)..(316): n is a, c, t, g, unknown, or other
  misc_feature (324)..(324): n is a, c, t, g, unknown, or other
  misc_feature (331)..(331): n is a, c, t, g, unknown, or other
aaagctggagctccccgcggtggcggccgctctagaactagtggatcccccgggctgcaggaattcgcacgagaccattacctagaacatcctaatcgaaaaaaaccttcgctgctgcttcgcaacggtgccgcggcttcggacagggctctcgcgacgcgatcggccatggcggcgtctctgcgggcctcgtcctccctccgctcgcgcctcctctcgttctcctcggggtggtctctgtgtccgtggcgtctcctcctctcctcaccctgtacactcgacgccccccanccagacgaacccctcgctttcaacnagatccanctgtcgnccggaaaacccgctacccgcactggcttcttcttgccggccttccttggtccgggcggaattggggctccttttcctggcccctggtttccaaaatccgaaacctccccctttaaaaaggggagaaggtttcccggattttggaaccctgggaaaacggggggaaaggggggtgccccgcccccaatttttttctcgcccaaaaaacccctctttttttaggccccccctttcccccaggcaacaatttttttcccccccccccgggggagagaaccccttttttttggggaaagacccccccccgggggggggaaacccttttttttctccaccacccggggggtgttgtttttttcacccacaaaaaaaa

SEQ ID NO: 40292 - protein, 127 aa, Zea mays
  misc_feature: Ceres CLONE 1432616-F
  misc_feature (41)..(41): Xaa is any aa, unknown, or other
  misc_feature (50)..(50): Xaa is any aa, unknown, or other
  misc_feature (52)..(52): Xaa is any aa, unknown, or other
  misc_feature (55)..(55): Xaa is any aa, unknown, or other
MAASLRASSSLRSRLLSFSSGWSLCPWRLLLSSPCTLDAPXPDEPLAFNXIXLSXGKPATRTGFFLPAFLGPGGIGAPFPGPWFPKSETSPFKKGRRFPGFWNPGKTGGKGGAPPPIFFSPKKPLFF

SEQ ID NO: 40293 - DNA, 661 bp, Zea mays
  misc_feature: Ceres CLONE 1432620-F
  misc_feature: Encodes the peptide sequence at SEQ ID NO. 40294
aagctggagctccccgcggtggcggccgctctagaactagtggatcccccgggctgcaggaattcgcacgagaccattacctagaacatcctaatcgaaaaaaaaagtacccaagctgaaaggacaacacttgcagagttctgcctctcggtctcggaacctcactccttcctctcctagtccccagcttcaccgaggcatacggtataccataccggcaccggcaccggcagcgagcagtcgggagccatggctccgccgctcctgctcttcctcctcctcctccccctcctcacggccctcgctgacggacaccagcacctgtcctcctacggctcctccgcgctctccgattggcgccccgccaaggcatcctactacgccgccgaccccgaagacgccatcggtggggcgtgcgggttcggggatctggggaaacacggctacgggatggcgacggtggggctgagcacggcgctgtttgagcgcggcgcggcgtgcggcggctgctacgaggtcaagtgcgtcgaggacctcaagtactgcctccccggcacctccatcgtcgtcacggcaaccaacttctgcgccccaaactacggccttcccgccgacgccggcggccactgcaacccgcccaaccaccatttcctcctcccca

SEQ ID NO: 40294 - protein, 137 aa, Zea mays
  misc_feature: Ceres CLONE 1432620-F
  misc_feature (70)..(137): Pfam Name: DPBB_1 Pfam Description: Rare lipoprotein A (RlpA)-like double-psi beta-barrel
MAPPLLLFLLLLPLLTALADGHQHLSSYGSSALSDWRPAKASYYAADPEDAIGGACGFGDLGKHGYGMATVGLSTALFERGAACGGCYEVKCVEDLKYCLPGTSIVVTATNFCAPNYGLPADAGGHCNPPNHHFLLP

SEQ ID NO: 40295 - DNA, 633 bp, Zea mays
  misc_feature: Ceres CLONE 1432623-F
  misc_feature: Encodes the peptide sequence at SEQ ID NO. 40296
tccccgcggtggcggccgctctagaactagtggatcccccgggctgcaggaattcgcacgagaccatacctagaacatcctaatcgaaaaagaacaaatatgagtctagactgtgatctcactgttctagaagagctaacatcaaatgcgaagcaaatacaagacgatgtattgaccaagatactcaaagctaacgcgaacacagtgtacctcggacgttttctccaggggagtgcggataaagagctgttcaagaagaacgtacccgtggtgagctatgaagatcttaagccttatctcgaccgtgtcgcaaacggagaaccctcggatgtcatttcgggggaacccatcactgcgtttttagtgagctctggaactttcagtgggaatcaaaagatatttcctgcgaaacacatcttctttaagatattcaaatcttctatacgctaagctatctcgtatggccaagcatttcaatggttataacccaaggaaggggattaggtttactttaattctccaaaatccaaaacccttgggggtggccccctggcccacgggaactgatttccaaaagagggatttttttgggcccggcaaaaaaacccccgcccccccacaaaattagtgggg

SEQ ID NO: 40296 - protein, 116 aa, Zea mays
  misc_feature: Ceres CLONE 1432623-F
MSLDCDLTVLEELTSNAKQIQDDVLTKILKANANTVYLGRFLQGSADKELFKKNVPVVSYEDLKPYLDRVANGEPSDVISGEPITAFLVSSGTFSGNQKIFPAKHIFFKIFKSSIR

SEQ ID NO: 40297 - DNA, 674 bp, Zea mays
  misc_feature: Ceres CLONE 1432629-F
  misc_feature: SWISSPROT Homolog: EC 5.3.1.1 Triose-phosphate isomerase
ggagctccccgcggtggcggccgctctagaactagtggatcccccgggctgcaggaattcgcacgagaccattacctagaacatcctaatcgaaaaattacctcctagcatctcatgctgccgtgtccgctttcgtgtctccaaaagcttttagctcctccggaatgctcggttctgaaagatatggcccaaaagttaattcgtctgaggtctgtgggtatgtcttcgaggtggtgatgatgtgaacaaaattggactacctcttgacgaagctcccgttccattcccgtggatcgcccctgcacggtgaggttactcctgcatatgtgtttcttcctcgggtatgtaacgcatagctgtctgagttccatgtactactgcaatcttgctggctatggaattgaggtgccttccctgtagaagacacctgccgacatgcatgtggccttgccactctcatgagttatgccttggccactcgtgacagcgcatgtgcttctcgacgtcctggagaacgttgttggagaccaggtagcctatgcccttgctcgacgttggattgtgactgctagggttaccgagactcttcatcaggagatgctgggtctaccatggatgatgtggctgaccatactgctgatattgctgcatcaatcgcgaactggtctttgttg

SEQ ID NO: 40298 - DNA, 663 bp, Zea mays
  misc_feature: Ceres CLONE 1432633-F
  misc_feature: Encodes the peptide sequence at SEQ ID NO. 40299
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaaatagtgagcgacggccgccacgggacaggcatggtgagcctcgagcggcagcacacccacagctacgactacgactacgagcacctcgtgctcgacccggaatatctgggcgtgccgtgggccgacccggccgccgaggagatcccgccggacctcctcgtcgcgctcggggagtacctctccggctccgcggcccgcggggacctcaaggcggaggcggacgaccagttcgtgatgcacgatttccacgtgcagctgtgcgcgcgcgcgcagacccacgagtgcgaggtgtgccactacgcccgccagggcgagggcgcgcggagacgagacccatcctccgtcgcctagtgctcgtagccatgcccagacatcaggagctcgccgggctgctgggccgcctccgcgtgcccgcgcggggcctcctgcccaacttccacactgtgctctctacctgtaacgtggcccgataacgctgccgcacgagcccaatgacgcggctgagtcccctgacaacgcctagagtgatctcttgtcttagaacagtattaccattagcgan

SEQ ID NO: 40299 - protein, 106 aa, Zea mays
  misc_feature: Ceres CLONE 1432633-F
MVSLERQHTHSYDYDYEHLVLDPEYLGVPWADPAAEEIPPDLLVALGEYLSGSAARGDLKAEADDQFVMHDFHVQLCARAQTHECEVCHYARQGEGARRRDPSSVA

SEQ ID NO: 40300 - DNA, 604 bp, Zea mays
  misc_feature: Ceres CLONE 1432638-F
  misc_feature: Encodes the peptide sequence at SEQ ID NO. 40301
  misc_feature (436)..(436): n is a, c, t, g, unknown, or other
  misc_feature (442)..(442): n is a, c, t, g, unknown, or other
  misc_feature (444)..(444): n is a, c, t, g, unknown, or other
  misc_feature (445)..(445): n is a, c, t, g, unknown, or other
tccccgcggtggcggccgctctagaactagtggatcccccgggctgcaggaattcgcacgagaccattacctagaacatcctaatcgaaaaaatatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctgggcatcttaactttatcacccttgttcctcccacaatcatcagccctattacagcagttacctttgcgtgcattaatggcacaaaacatcanggcacnanncaactacacacttgtgctaacaaacttgctgcctactctcagcaacaacagttcctccattgcaaccactagctgcattgaactctgcttacttattgcaatcacacaactaccattcagccagctacgtgctagctaccccaggaatttactccatta

SEQ ID NO: 40301 - protein, 121 aa, Zea mays
  misc_feature: Ceres CLONE 1432638-F
  misc_feature (95)..(95): Xaa is any aa, unknown, or other
  misc_feature (98)..(98): Xaa is any aa, unknown, or other
MAAKIFCLLMLLGLSASAATATIFPQCSQAPIASLLPPYLSPVVSSVCQNPILEPYRIQQAIAAGHLNFITLVPPTIISPITAVTFACINGTKHXGTXQLHTCANKLAAYSQQQQFLHCNH

SEQ ID NO: 40302 - DNA, 634 bp, Zea mays
  misc_feature: Ceres CLONE 1432639-F
  misc_feature: Encodes the peptide sequence at SEQ ID NO. 40303
gagctccccgcggtggcggccgctctagaactagtggatcccccgggctgcaggaattcgcacgagacctttacctagaacatcctaatcgaaaaatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccacccctcggcgcccgcatcccggtgggtggacctctcggtgacgcggcgcgaggacctagtcgagcaggtgaggcacgcgggccggggacggtgggctttctctggctggggaacacggcgtggcaaaggagctgatgggcggcatgctccgcggggtggcgcagttcaccgagggccccgttgaaagcaaacaagggctctacttccaggaacctgggtcggaacttgggcttcgccctcaatttcaaccttttaaggcccctgggggccaaatgggccaacacccctttgggaaggg

SEQ ID NO: 40303 - protein, 110 aa, Zea mays
  misc_feature: Ceres CLONE 1432639-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPSSPPLGARIPVGGPLGDAARGPSRAGEARGPGTVGFLWLGNTAWQRS

SEQ ID NO: 40304 - DNA, 643 bp, Zea mays
  misc_feature: Ceres CLONE 1432646-F
  misc_feature: Encodes the peptide sequence at SEQ ID NO. 40305
  misc_feature (600)..(600): n is a, c, t, g, unknown, or other
  misc_feature (625)..(625): n is a, c, t, g, unknown, or other
aagctggagctccccgcggtggcggccgctctagaactagtggatcccccgggctgcaggaattcgcacgagaccattacctagaacatcctaatcgaaaaattttgcaggaatccaaatcattcgccctctagatcgtgctgccatgtctctgtccacccccaccaccttgtgttccgcgacgtctcctctctctctctctctctctagagttgctgatagtttttttactaactcactccaccaaatccgttccaattccggtgcaaactgcttgttcgtgcgagacaataaagccatggaactagctaacccttgctgaactgtggaatggtttctgagcagagcgtggcggagctgaagcagaccctgctggcgaccacgctggagctggaggcggcgagggaggagctgaggcggaaggagcagagcatcgccaagctgtcggacctggtgcgcgaggtggccaaggagcgcgacgacgcgcgggaaccagcgcagagcctccgcctcctcgctgcccaggccgcgccgccgctcgtcacgtccagcgtcaccgactccgactgcagcctcgcgtcgtcccccgtggaaccgttnctcgaccccgtcacgtccgccgacnacaggcggcgctgcaagt

SEQ ID NO: 40305 - protein, 104 aa, Zea mays
  misc_feature: Ceres CLONE 1432646-F
  misc_feature (90)..(90): Xaa is any aa, unknown, or other
  misc_feature (99)..(99): Xaa is any aa, unknown, or other
MVSEQSVAELKQTLLATTLELEAAREELRRKEQSIAKLSDLVREVAKERDDAREPAQSLRLLAAQAAPPLVTSSVTDSDCSLASSPVEPXLDPVTSADXRRRCK

SEQ ID NO: 40306 - DNA, 666 bp, Zea mays
  misc_feature: Ceres CLONE 1432661-F
  misc_feature: Translation starting site: 172
aaagctggagctccccgcggtggcggccgctctagaactagtggatcccccgggctgcaggaattcgcacgagaccattacctagaacatcctaatcgaaaacacacccgcatctgcttcattccacccgccccgcgaggagcttctagaaggggagaccccggcggagccatggcggaggaaaaggagtcgacgtcgatcccgctcagccaggcggcggaggctgtcgaccccgaggacccggccaagtcgccgccgcgacccagctcgcccaccacctccacacgcaagtcccctatatgcaaaaattggaatcgacatatttggtcttggttttttgacttctctggtattcatatttctggttggaatatttgtttcttcatgggttggttcaaccatcttctgggtgggcgagtggtttataaagaaatccatttgtaagacatatatattcagcatcaaagcaagtcagcactgcaatttcaccagatcaaaatacgactgctttcaaagaagttgcaataattcgtcatccacgaattggtgaatatgcatttggattcataacatcaacggtggtccttcagactgacaaaggcgatgaagaactgtgtagtgtgtatgtgccaacaaatcatctatacatcggtgacatatttctgg

SEQ ID NO: 40307 - DNA, 663 bp, Zea mays
  misc_feature: Ceres CLONE 1432662-F
  misc_feature: Encodes the peptide sequence at SEQ ID NO. 40308
aaagctggagctccccgcggtggcggccgctctagaactagtggatcccccgggctgcaggaattcgcacgagaccattacctagaacatcctaatcgaaaaataggaatcatccatcgcgtctgtgctccccctcgcgcaatcctaccgcactcgcctcccgaaatcggccgccacggcgcctcacgccatggctcctgcccagcagctgcagctccctccgcctccggtggtctggcacgccgcctcctcgcccagatccgtccgtggtccgcccctccggcctcgcccagctccaaagctccctcctgctcgcgggcacgcgatctcgccctgggggccatgccctaggccgtcgtctcggctcgcgtccacctcgtccagcgtcacaagtggcgccgccgccggtgtcggctacttcgatctcccgcccgccgtcgactcgtccagcagtacctacgctctgaatccgatcccctcgccggtggcgacggcgtcggctgacccatccccaaactcggcgcgggagcccaagcggaagcgaactggcccgtgcgtcccccgcatcaactcgaaccgaagggacgaccaagcggagtctagactcaagagcaaccgcgacctcccggatctctctcccacccacgcctcgtcaccgtcgtc

SEQ ID NO: 40308 - protein, 157 aa, Zea mays
  misc_feature: Ceres CLONE 1432662-F
MAPAQQLQLPPPPVVWHAASSPRSVRGPPLRPRPAPKLPPARGHAISPWGPCPRPSSRLASTSSSVTSGAAAGVGYFDLPPAVDSSSSTYALNPIPSPVATASADPSPNSAREPKRKRTGPCVPRINSNRRDDQAESRLKSNRDLPDLSPTHASSPS

SEQ ID NO: 40309 - DNA, 644 bp, Zea mays
  misc_feature: Ceres CLONE 1432688-F
  misc_feature: Encodes the peptide sequence at SEQ ID NO. 40310
  misc_feature (398)..(398): n is a, c, t, g, unknown, or other
  misc_feature (419)..(419): n is a, c, t, g, unknown, or other
  misc_feature (529)..(529): n is a, c, t, g, unknown, or other
aagctggagctccccgcggtggcggccgctctagaactagtggatcccccgggctgcaggaattcgcacgagaccattacctagaacatcctaatcggaaaaacaccgagaatcacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcanggtgcaggtggaggacgagcnggtgctggtgatcagcggcgagcggcgccgggaggagcgcgaggacccccagtacctgcgcatggagcggcggatgggcaaagtcatgcgcaagttcgtgctgccggacnacgccgacgtggacaaggtcgccgccgtgtgcagggacggcctgctcaccgtgaccgtcgagaagctgccccccgcggaagcccagaggcccaagacatcgagataaaggccccg

SEQ ID NO: 40310 - protein, 150 aa, Zea mays
  misc_feature: Ceres CLONE 1432688-F
  misc_feature (49)..(149): Pfam Name: HSP20 Pfam Description: Hsp20/alpha crystallin family
  misc_feature (72)..(72): Xaa is any aa, unknown, or other
  misc_feature (79)..(79): Xaa is any aa, unknown, or other
  misc_feature (116)..(116): Xaa is any aa, unknown, or other
MDARMFGLETPRVAALHHLLDVPDGDKAGGGATRTYVRDARAMAATPADVKELAGAYAFVVDMPGLSTGDIXVQVEDEXVLVISGERRREEREDPQYLRMERRMGKVMRKFVLPDXADVDKVAAVCRDGLLTVTVEKLPPAEAQRPKTSR

SEQ ID NO: 40311 - DNA, 655 bp, Zea mays
  misc_feature: Ceres CLONE 1432711-F
  misc_feature: Encodes the peptide sequence at SEQ ID NO. 40312
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (238)..(238): n is a, c, t, g, unknown, or other
  misc_feature (240)..(240): n is a, c, t, g, unknown, or other
  misc_feature (253)..(253): n is a, c, t, g, unknown, or other
  misc_feature (257)..(257): n is a, c, t, g, unknown, or other
aaagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagcagggttctggcgggcggcgnnnnnncttncngctccccttcccnttgncctccccgatggcgctccgcctccacgacgtcgcgctctgcctctccccgccgctcgccgtccggcgccgccgtcgcagccgcggctggttcttcgctgtcgcctccttgacttccgccctctccccctaggtcgagaataagaagccatttgctcctccaaaggaggtacatgtacaagatacacattcaatgccacctcgcaacaatgaaaatttcaaggcccatgctgattaggatagaaattatatcctgacgcatctcaagccaatccagaaatggttggagccacaggatttcctcccgaaccaacatctgacggaattcacgaagaaagttagtgatttaaagaaggcgacaaggaaacccctgaggataattttatttggctgggaagga

SEQ ID NO: 40312 - protein, 40 aa, Zea mays
  misc_feature: Ceres CLONE 1432711-F
MALRLHDVALCLSPPLAVRRRRRSRGWFFAVASLTSALSP

SEQ ID NO: 40313 - DNA, 662 bp, Zea mays
  misc_feature: Ceres CLONE 1432715-F
  misc_feature: Encodes the peptide sequence at SEQ ID NO. 40314
  misc_feature (437)..(437): n is a, c, t, g, unknown, or other
aaagctggagctccccgcggtggcggccgctctagtactagtggatcccccgggctgcaggaattcgcacgagaccattacctagaacatcctaatcgaaaaacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcacagcggtgtcttcagtatgtgaaaaacccaattcttcaaccctacaggatccaacaggcaatcgcagcaggcatcttaccttatcaccctttgtctccaacaaccgtcagccctattacagcagttacctttggtgcatttggtggcacaaacatcanggcacaaacactaacacaacttgtgctaggaaactttgttgcttactcccagcaaaggagttttcttccattcaaccaatgggctggattgaacctcgccggttatttggaaaaaaaactacctttcagtcaggtagggtggggcctacccccaaaaatttcttcctttaaacccaagggggaaaattaaacctccgccgttttttttaccccgccccccccccc

SEQ ID NO: 40314 - protein, 156 aa, Zea mays
  misc_feature: Ceres CLONE 1432715-F
  misc_feature (94)..(94): Xaa is any aa, unknown, or other
MAAKIFCFLMLLGLSASAATATIFPQCSQAPIASFLPPYLSQRCLQYVKNPILQPYRIQQAIAAGILPYHPLSPTTVSPITAVTFGAFGGTNIXAQTLTQLVLGNFVAYSQQRSFLPFNQWAGLNLAGYLEKKLPFSQVGWGLPPKISSFKPKGEN

SEQ ID NO: 40315 - DNA, 625 bp, Zea mays
  misc_feature: Ceres CLONE 1432719-F
  misc_feature: Encodes the peptide sequence at SEQ ID NO. 40316
ggagctccccgcggtggcggccgctctagaactagtggatcccccgggctgcaggaattcgcacgagaccattacctagaacatcctaatcgaaaagacgctcgacgcctctcctcctctcctcccccacccgtccatcgcccctccctccggtctgcgctcccacagcctcacccctgcgcccccgccgattcgcatcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagagatccttcgcgcagcagcactacgctgacctttccgacaagcctttcttccccgggttggtggagtacatcatttccggccccgtggtggcgatggtgtgggaggggaaggacgtcgtgttgactggccgtaggatcattggggccaccaggccttgggaggcagcccccggtaccattcgtggggactacgccgtggaagtcggcaggtgaacatccctttctttgtactcgatcagttgtgctttgctgcgaatgttttagtttggacactttaatagcc

SEQ ID NO: 40316 - protein, 111 aa, Zea mays; identical to SEQ ID NO: 38071
  misc_feature: Ceres CLONE 1432719-F
  misc_feature (2)..(111): Pfam Name: NDK Pfam Description: Nucleoside diphosphate kinase
  misc_feature: SWISSPROT Homolog: EC 2.7.4.6 Nucleoside-diphosphate kinase

SEQ ID NO: 40317 - DNA, 611 bp, Zea mays
  misc_feature: Ceres CLONE 1432736-F
  misc_feature: Encodes the peptide sequence at SEQ ID NO. 40318
aaagctggagctccccgcggtggcggccgctctagaactagtggatcccccgggctgcaggaattcgcacgagaccattacctagaacatcctaatcgaaaaaaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttaacatagtgcaggagtatgtcaagtcgcactagatgt

SEQ ID NO: 40318 - protein, 140 aa, Zea mays; identical to SEQ ID NO: 4593
  misc_feature: Ceres CLONE 1432736-F
  misc_feature (25)..(120): Pfam Name: Ribosomal_L7Ae Pfam Description: Ribosomal protein L7Ae/L30e/S12e/Gadd45 family

SEQ ID NO: 40319 - DNA, 625 bp, Zea mays
  misc_feature: Ceres CLONE 1432740-F
ggagctccccgcggtggcggccgctctagaactagtggatcccccgggctgcaggaattcgcacgagaccattacctagaacatcctaatcgaaaaaagacgatctgcgaaacaaacactagtgcgtttgcgagagaaaccgagaaagagaagctacagagtcactgaccgaccgctatggcatcgaggcagaacacgcgtgaggcgcgcgccgaggccgacgcgcggcgcgccgtggagggagctggctcgggcgcgggacgagcacctcgagaaggcggaggtgaacgccccgctcgggcgcggacgagatcgcgcgctcccgcgccgaacgcggtgccgccggttgcggccgcatcctggaaagcgtgcaggagggcgccaggtcctttgcccccggcctggggcccccctttcgggggggcccagggaccccaccgggaaaaaaacctcccaaaagggggccaccccgcgggggaaaaacttcgcgagaaaaggggacataccccccccaaaagggccccgggagggcaaaaaacaatttttctccgataaaaaggggcaaaacgggcggagaatcccccccgaaaaaaagtggggggaaaaaaaaagaaacccccccgag

SEQ ID NO: 40320 - DNA, 662 bp, Zea mays
  misc_feature: Ceres CLONE 1432750-F
  misc_feature: Translation starting site: 206
aaagctggagctccccgcggtggcggccgctctagaactagtggatcccccgggctgcaggaattcgcacgagaccattacatagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctggtcggggctggcgctgacggcctccgtgggtggggctggccgtggccacgccggtgttcctgatcttcagccccgtgctggtccccgccgcgctgctcatcgggacggccgacatggggtccctcacgtcgggcgcgctgggggatcgggggcgtgtcctcggtcagtgcctcgcagaagggggcggcaggcggacatcgcacccggactacgtggagaggcgcccgcaggatggaggatgcgacgcgcatgcagggcagagaca

SEQ ID NO: 40321 - DNA, 799 bp, Zea mays
  misc_feature: Ceres CLONE 1432765-F
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (225)..(225): n is a, c, t, g, unknown, or other
  misc_feature (266)..(266): n is a, c, t, g, unknown, or other
  misc_feature (269)..(269): n is a, c, t, g, unknown, or other
  misc_feature (277)..(277): n is a, c, t, g, unknown, or other
  misc_feature (296)..(296): n is a, c, t, g, unknown, or other
  misc_feature (306)..(306): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (314)..(314): n is a, c, t, g, unknown, or other
  misc_feature (315)..(315): n is a, c, t, g, unknown, or other
  misc_feature (318)..(318): n is a, c, t, g, unknown, or other
  misc_feature (322)..(322): n is a, c, t, g, unknown, or other
  misc_feature (324)..(324): n is a, c, t, g, unknown, or other
  misc_feature (327)..(327): n is a, c, t, g, unknown, or other
  misc_feature (440)..(440): n is a, c, t, g, unknown, or other
  misc_feature (441)..(441): n is a, c, t, g, unknown, or other
  misc_feature (461)..(461): n is a, c, t, g, unknown, or other
gggggggggggcccccccccgttgtgtnnnnnnnntttaattttngggggccnnnnccaaactggggctccccgcggtggcggccgctctagaactagtggatcccccgggctgcaggaattcgcacgagaccattacctagaacatcctaatcgaaaaatcgcccgccgtcctctcctctcctccccggccccttcactgcaccaacgaaccccacgcaggcancatcacgcgcaagccgcaaggcaaggcacaaacactaagtnccnggtatggngacgcgggtggacttgganaagggggggngggnnnannaangaancnagnaaggagccgcacggcgcgggggccccaggttgaggggggacggtagtggttgcccctggctcggcgtggggatcttctgtcccagcatcacccggcttcgttcttcaccatgnnacggcaaacaggtggccccncaccccctacggcaacaacccccccccccccggcgttgggggggcgggcttcgtgcctttcaaacccactggccgacaaaaaccccgcttcttccggggccctacctcccgccacggctgcaccaaataacggggggccccctgggtggtgggaagaagggagggtgggccccgcccgcccaggggggggggcaccctccgccgtcccggcggggggggcgtcccacggccgggggggggatccccccgggggccaccctaaaaagggtcttgggccaccccttctttggaggggggcggggagccctgcggaacggcgggggtggcggggagcccgg

SEQ ID NO: 40322 - DNA, 647 bp, Zea mays
  misc_feature: Ceres CLONE 1432767-F
  misc_feature: Translation starting site: 177
  misc_feature: SWISSPROT Homolog: EC 1.3.1.9 Enoyl-[acyl-carrier-protein] reductase (NADH)
cgcggtggcggccgctctagaactagtggatcccccgggctgcaggaattcgcacgagaccattacctagaacatcctaatcaaaaaactatcctatcacgcaccactcgaattgtgtgctcatccacatccccttcccgcatttcctaaagccaagttagttagctttgaagacgatgactgcttctgcaattgctggtgtgcacatggtgactgcacacccttgcttttccgcctccccactaattcttaccgcacctgattctatcactgattgcatgctcatcaccactgctacattctccagaatcacctgctcctggcctataaggtttaagcgcaatgactgctgttgtaactagatctatccgaaggaggcgcaccccatcgccttcctcttgatctcgtatgtaaaagcgaatttcttgctggagttcctgatcactatcgctatctacggccccttgctaaggcacttcctccccctggtgctgaaactcctgtactgacatgcgcgcctgctcttaacctatttgacacgattcctactccgctatctctatgatgaatcacggacactgcacattcatctctaatggatattcttaaagtctatccacttgactctatatactaatcacctgatg

SEQ ID NO: 40323 - DNA, 753 bp, Zea mays
  misc_feature: Ceres CLONE 1432775-F
  misc_feature: Encodes the peptide sequence at SEQ ID NO. 40324
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (53)..(53): n is a, c, t, g, unknown, or other
  misc_feature (55)..(55): n is a, c, t, g, unknown, or other
  misc_feature (753)..(753): n is a, c, t, g, unknown, or other
gtggggggggtgtggtggggttgccgccccaggcaccaaacacacccnnncantnaaaacaggagctgaccccggtggcgggcgctctacactaatggatcccccgggctgcaggaagtcggacgagaccattacctagaacatcctaatcgaaaacaagacaaatccaaccaaccaagctattccccatctccggaccagcgccgcctccagtcgctgtccacgggcaccccgggcgcgcctcctccgagcccagactcgagctccatcccgccgtggatcaccgcgtgaggtggggcgcaccgaccggaccccggagggccaaatggtgtccggcgccggagggggcgagtaccgcggtcggccgccagaaacagattggcgccggcggggagaggcgtctgtcggagcgggggccaccatgtctggtgtattataccccaagaggtcctcctccgtggggggggagggggggccccccgggggcccttcctcgcctggggccacttgccaccaccatcacccccccaaaaaggccccgatgctccccgtcccgggtgaggggaggggctactccagcacctcctggagcgtggtcggccgacatggagtcccccagcacttggaaagagctcgttgacgcgctcggcgaaatcgacttgggaactcccgcctgaaaggagatgtcaacgaagctgggcggcggggacggcagggtgggggctatgccgcaaaaagcccgcgtggcctggn

SEQ ID NO: 40324 - protein, 104 aa, Zea mays
  misc_feature: Ceres CLONE 1432775-F
MVSGAGGGEYRGRPPETDWRRRGEASVGAGATMSGVLYPKRSSSVGGEGGPPGGPSSPGATCHHHHPPKKAPMLPVPGEGRGYSSTSWSVVGRHGVPQHLERAR

SEQ ID NO: 40325 - DNA, 666 bp, Zea mays
  misc_feature: Ceres CLONE 1432797-F
  misc_feature: Translation starting site: 313
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (385)..(385): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctggggctccccgcggtggcggccgctctagaatagtggatcccccgggctgcaggaattcgcacgagaccattacctagaacatcctaatcgaaaaaaagaaaaaggaaattttcttgggcgttcttcggcttcgttgtcacaaggttcgagttcgtcaccgtctagtacgactgtgcgagggaggaagaggcgaagagaaaatgcagatcttcgtgaagaccctgacggggaaagacatcaccctcgaggtggagagcagcgacaccgtcgacnacgtcaaagcaaaatcccaggacaggaagggatttcccccagatcacagcgactgatattcgctggcaagcagctggaagatggacccccgctggctgactacaacatccaaaaggaatcaactcttcatttgggtctcagggcttaggggtggaaccctgatcagggtcaaaaattctcctgggaaaaaaaatcgaaaatcaacattgaacccccttggccccatttgaacggaatccaggggacgtgttttaaaaaaaaaaaaaggcattcctctcccg

SEQ ID NO: 40326 - DNA, 673 bp, Zea mays
  misc_feature: Ceres CLONE 1432802-F
  misc_feature: Encodes the peptide sequence at SEQ ID NO. 40327
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
acaagctggagctccccgcggtggcggccgctctagaactagtggatcccccgggctgcaggaattcgcacgagannnttacctagaacatcctaatcgaaaaattatctccctgactcgcctcgtcctccagatatcggccgccaccttcacctccaccgccccggcgcacctgtgcgtctccatcgtnnncgcctctcctccttcggacacgactgaccttccactggcgccaacgaagaaaacacataggaagaagctcaccgccaaacctcatccagatccagtcgctgccctccgnnngccgcatacggaacgtctcgtctcttcctttggatccggcggtcaactccatcacccccagcttcacctcccttagtccccctccgtccgctctcacccaccgcttctatatcgccacnnntctcgttgtagaagaagacactgaggatctggctttctggaatcacatttcttgagaactatctgttggagaactaaactaggctcttgttcatattatggatcagcaagctaagattgatgctnnnnttcttgaaccaactgtactcttagatgagacacattaccaggaggggtacaaaaatggctataatgatggtttggcatctggaaaggaagaggggaggcaggttggtttaaagatgggttt

SEQ ID NO: 40327 - protein, 50 aa, Zea mays
  misc_feature: Ceres CLONE 1432802-F
  misc_feature (10)..(10): Xaa is any aa, unknown, or other
  misc_feature (11)..(11): Xaa is any aa, unknown, or other
MDQQAKIDAXXLEPTVLLDETHYQEGYKNGYNDGLASGKEEGRQVGLKMG

SEQ ID NO: 40328 - DNA, 659 bp, Zea mays
  misc_feature: Ceres CLONE 1432806-F
  misc_feature: Encodes the peptide sequence at SEQ ID NO. 40329
  misc_feature (71)..(71): n is a, c, t, g, unknown, or other
  misc_feature (72)..(72): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
aaagctggagctccccgcggtggcggccgctctagaactagtggatcccccgggctgcaggaattcgcacnnaaccattacctagaacatcctaatcgaaaagtacccatcgctcactacgcgaccgctagctactccgatcggatcctgaccacgcccgcctaccaggccaccaccaccacnnncacccacaaatccccaatggcgaggcgcatcgccgtggcggcagcgttcctggcgctggccgtggtggctcccgccgcgctggcgcaggctcccgggcccgcggcnnngcctagcgggccgccgaacgtgacggcgatcctggagaagggcgggcagttcaccatgttcatgcggctgatgaaggagacgcagcaggacacgcagctgaacagccagctgaacannncgtacgccagcagcggcggcgggtacacggtgttcgcgcccaccgacaacgccttcaacaacctcaagcccggcacgctcaactcgctgacgcagcagcagcaggtggcgctggtgcagggcnnnntcctgccccagttctacagcatggactccttccagaccgccagcaaccccgtccgcacccaggcctccggccgcgacgggccctacacgctcaacatcaccgccaccgccaacaaccaggt

SEQ ID NO: 40329 - protein, 152 aa, Zea mays
  misc_feature: Ceres CLONE 1432806-F
  misc_feature (47)..(147): Pfam Name: Fasciclin Pfam Description: Fasciclin domain
  misc_feature (31)..(31): Xaa is any aa, unknown, or other
  misc_feature (70)..(70): Xaa is any aa, unknown, or other
  misc_feature (71)..(71): Xaa is any aa, unknown, or other
  misc_feature (112)..(112): Xaa is any aa, unknown, or other
  misc_feature (113)..(113): Xaa is any aa, unknown, or other
MARRIAVAAAFLALAVVAPAALAQAPGPAAXPSGPPNVTAILEKGGQFTMFMRLMKETQQDTQLNSQLNXXYASSGGGYTVFAPTDNAFNNLKPGTLNSLTQQQQVALVQGXXLPQFYSMDSFQTASNPVRTQASGRDGPYTLNITATANNQ

SEQ ID NO: 40330 - DNA, 670 bp, Zea mays
  misc_feature: Ceres CLONE 1432810-F
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (18)..(18): n is a, c, t, g, unknown, or other
  misc_feature (19)..(19): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (167)..(167): n is a, c, t, g, unknown, or other
  misc_feature (168)..(168): n is a, c, t, g, unknown, or other
  misc_feature (170)..(170): n is a, c, t, g, unknown, or other
  misc_feature (172)..(172): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (215)..(215): n is a, c, t, g, unknown, or other
  misc_feature (219)..(219): n is a, c, t, g, unknown, or other
  misc_feature (225)..(225): n is a, c, t, g, unknown, or other
  misc_feature (226)..(226): n is a, c, t, g, unknown, or other
  misc_feature (297)..(297): n is a, c, t, g, unknown, or other
  misc_feature (304)..(304): n is a, c, t, g, unknown, or other
  misc_feature (305)..(305): n is a, c, t, g, unknown, or other
ggggnnnggtttggtagnnaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnanngncnggnnnnnnnnnnnnnnnnnnccaaaagctgggggctccaccgncggntggcgnngccgctctaaaactagtgggatcccccggggctgcagggaattcgcacgaagacattacctagaacatccntaatcgnnaaagtctgtctcacactagctgctgtgggacgatcgaagtgggtgtgtcagctagctagctgcggcgtgacacgcacatgaccgcagtgcgcgcggggctgatccaaggaaaatgatcggaatgggactgggaccttggggttcgggccccccaaaaccgcattaaacccgttggggggcccccccccaaaaattttgggggggtcctcccaaaaaaatttttggtggggttttgggggggaaaaaaaaaaggggttttttgggggaaaaactttttgggggggggcccccaaaagggggggcaaacatttttttcccctttttttttggggggggggggggggggggggcccccccccggcggg

SEQ ID NO: 40331 - DNA, 662 bp, Zea mays
  misc_feature: Ceres CLONE 1432815-F
  misc_feature: Encodes the peptide sequence at SEQ ID NO. 40332
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaannnngcgtgcgagtggcagtacggaaaggacaccccgcggaagagggaatgcgagagcgagtgccgcgagcggcaccagcaagctgacgcgggcgaggnnnncgacagcggcgtggacgcctacgtctcccgctccgggaggggcgagtgccggcgccagtgcctgcgccgccacgagggccagccgnnnaagacccaggagtgcatgaggcggtgccgccgccgcggactggccgtcgacatggagcaagagtacggtcgcggcagcgagagcgcgggcaagnnnnnggagaggtgcgagcgccccaccgc

SEQ ID NO: 40332 - protein, 149 aa, Zea mays
  misc_feature: Ceres CLONE 1432815-F
  misc_feature (46)..(46): Xaa is any aa, unknown, or other
  misc_feature (47)..(47): Xaa is any aa, unknown, or other
  misc_feature (79)..(79): Xaa is any aa, unknown, or other
  misc_feature (80)..(80): Xaa is any aa, unknown, or other
  misc_feature (109)..(109): Xaa is any aa, unknown, or other
  misc_feature (141)..(141): Xaa is any aa, unknown, or other
  misc_feature (142)..(142): Xaa is any aa, unknown, or other
MGKGSVGASWWAFLLLAGVLLVVAATAGAEDGVVERDRKEDLRWCXXACEWQYGKDTPRKRECESECRERHQQADAGEXXDSGVDAYVSRSGRGECRRQCLRRHEGQPXKTQECMRRCRRRGLAVDMEQEYGRGSESAGKXXERCERPT

SEQ ID NO: 40333 - DNA, 646 bp, Zea mays
  misc_feature: Ceres CLONE 1432817-F
  misc_feature: Encodes the peptide sequence at SEQ ID NO. 40334
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (437)..(437): n is a, c, t, g, unknown, or other
  misc_feature (526)..(526): n is a, c, t, g, unknown, or other
  misc_feature (621)..(621): n is a, c, t, g, unknown, or other
  misc_feature (642)..(642): n is a, c, t, g, unknown, or other
tccccgcggtggcggccgctctataactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgtcgcatcggcggcggcaagagcaacgccccgcgactgcgacactactgccgccttcgcggcgggcgacggcagtgccggcgccgtggacttttnnnncgagcaggccaagaccgccgacgtgttcggtgggcggaccggcggcggcggcctcttcggcggcgtccacggcccgctgggcggcggcgtcggnaagaagggcccgttcggcggggccgtcgccggcgcgggcccgttcggcgggttcggaggcggcggcggcctcggtggacggaagaaaantacgaggaggagcaggtggcgcccgcgtcccgtgagtcttgaacaacgatgtgcatggccatggatgcatgcatgcctgcgcctcttataggggnccccccccccccaggcccccncccc

SEQ ID NO: 40334 - protein, 139 aa, Zea mays
  misc_feature: Ceres CLONE 1432817-F
  misc_feature (48)..(48): Xaa is any aa, unknown, or other
  misc_feature (49)..(49): Xaa is any aa, unknown, or other
  misc_feature (110)..(110): Xaa is any aa, unknown, or other
MAAKWWLVASLLLCLAVASAAARATPRDCDTTAAFAAGDGSAGAVDFXXEQAKTADVFGGRTGGGGLFGGVHGPLGGGVGKKGPFGGAVAGAGPFGGFGGGGGLGGRKKXTRRSRWRPRPVSLEQRCAWPWMHACLRLL

SEQ ID NO: 40335 - DNA, 671 bp, Zea mays
  misc_feature: Ceres CLONE 1432824-F
  misc_feature: Encodes the peptide sequence at SEQ ID NO. 40336
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
tggagctccccgcggtggcggccgctctagaactagtggatcccccgggctgcaggaattcgcacgagaccattacctagaacatcctaatcgaaaaacaaacacgtgacacctccgcccaccctcgccccctccctaccggcaccgcccagatggcctgctcccacatcgccgccgcgggggtctcctcccccgccgcagcggcggctcgttccccggcgcattctcccgcttccgccttcgcgcgcctccggtcgacgcctcgtttcgcgagcgctggcttgtcggttaagggaaacggagcggcgttcccgttggtcgccgccgcggggccggccgcggcggcaccggtggcnnncctggacggccgcccggccacggagaagcagcccatcatcgtcatcgacaactacgacagcttcacatacaacctctgccagtatatgggggagcnnnnattgaacttcgaagtataccgcaatgatgaactgaccatagaagatgtgagaaggaagaacccaaggggaatacttatttctccaggnnnnggtgaaccacaagattcgggaatatcattgcagactgttcttgaattaggcccaaccatcccaatttttggagtttgcatgggtctgcaatgcnnnnnagaggcatttggaggacagattatc

SEQ ID NO: 40336 - protein, 173 aa, Zea mays
  misc_feature: Ceres CLONE 1432824-F
  misc_feature: SWISSPROT Homolog: EC 4.1.3.27 Anthranilate synthase
  misc_feature (69)..(69): Xaa is any aa, unknown, or other
  misc_feature (101)..(101): Xaa is any aa, unknown, or other
  misc_feature (102)..(102): Xaa is any aa, unknown, or other
  misc_feature (132)..(132): Xaa is any aa, unknown, or other
  misc_feature (164)..(164): Xaa is any aa, unknown, or other
  misc_feature (165)..(165): Xaa is any aa, unknown, or other
MACSHIAAAGVSSPAAAAARSPAHSPASAFARLRSTPRFASAGLSVKGNGAAFPLVAAAGPAAAAPVAXLDGRPATEKQPIIVIDNYDSFTYNLCQYMGEXXLNFEVYRNDELTIEDVRRKNPRGILISPGXGEPQDSGISLQTVLELGPTIPIFGVCMGLQCXXEAFGGQII

SEQ ID NO: 40337 - DNA, 719 bp, Zea mays
  misc_feature: Ceres CLONE 1432825-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (290)..(290): n is a, c, t, g, unknown, or other
  misc_feature (300)..(300): n is a, c, t, g, unknown, or other
  misc_feature (370)..(370): n is a, c, t, g, unknown, or other
  misc_feature (379)..(379): n is a, c, t, g, unknown, or other
  misc_feature (382)..(382): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (469)..(469): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
nnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnccaaagctggggctccccgcggtggcggccgctctagaatagtggatcccccgggctgcaggaattcgcacgagaccattacctagaacatcctaatcgaaaagaatgaaacccgattcacaaaaccctagcgacctcgattcctcaccagcatggccgtcggcccctactctctcggnctctctccgnccgcgcggcttgataccatcctctttccacagctgcggcctcacctacgccgccgccgtgcctgctcggnttgctgcanccngcactaacttgtctccccnnnccggtgactcccaaaaccggggtcggcggctggtgggttccccgagtccaaaaatccataaaaccnggcaagggggaagattgggtttaaaannnngttgccggggttggggttgggaaactttttcggggaaatccccttggtggggggggggggggggctctccccctttccccaaaaaagggnnnacaacaaccatggggggcccccttcccccctatttcccaaaaaaattttccccccaaaaaaggccccaaaaagaaaacttggggggggggggcggggnnngggggggggggggggggagggggggtgt

SEQ ID NO: 40338 - DNA, 642 bp, Zea mays
  misc_feature: Ceres CLONE 1432837-F
  misc_feature: Encodes the peptide sequence at SEQ ID NO. 40339
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
aaagctggagctccccgcggtggcggccgctctagaactagtggatcccccgggctgcaggaattcgcacgagaccattacctagaacatcctaatcgaaaaaaggggggagagcatcgtcagctagcagagagagtgcgtagcaactagctagcaatggcggagaaccctgctccgagttccccgctagtgacttctcccgacgccgctgcgccgcctctgccagcggagttcaccaagctcaccttccgtagcctgtacatccgtcggacaggtccaggcagccgggagannnctgtggacgggaggccgtctgaccagctgggacgacggttcgtgagcgactttcccatatacgatggccgtggctccggcgcccgcctcgtcgctcgcttgcagggagtcactgtccaaatcggcagctcgnnncagctagtcagcatcgtcttcgaggccgagaggcttaagggctccacgctgctcaccaacggagtgataacggatgggtcagacgagtgggcgatctacggtggcaccggggtgttcnnnatggccaccggtgtcatacgaagaaggtttgtcgccggtagcaacgacggcaactctgatgagcttaccagcatcgaagttttctggcccggc

SEQ ID NO: 40339 - protein, 162 aa, Zea mays
  misc_feature: Ceres CLONE 1432837-F
  misc_feature (11)..(160): Pfam Name: Dirigent Pfam Description: Dirigent-like protein
  misc_feature (46)..(46): Xaa is any aa, unknown, or other
  misc_feature (47)..(47): Xaa is any aa, unknown, or other
  misc_feature (91)..(91): Xaa is any aa, unknown, or other
  misc_feature (131)..(131): Xaa is any aa, unknown, or other
MAENPAPSSPLVTSPDAAAPPLPAEFTKLTFRSLYIRRTGPGSREXXVDGRPSDQLGRRFVSDFPIYDGRGSGARLVARLQGVTVQIGSSXQLVSIVFEAERLKGSTLLTNGVITDGSDEWAIYGGTGVFXMATGVIRRRFVAGSNDGNSDELTSIEVFWPG

SEQ ID NO: 40340 - DNA, 612 bp, Zea mays
  misc_feature: Ceres CLONE 1432843-F
  misc_feature (311)..(311): n is a, c, t, g, unknown, or other
  misc_feature (312)..(312): n is a, c, t, g, unknown, or other
  misc_feature (321)..(321): n is a, c, t, g, unknown, or other
  misc_feature (407)..(407): n is a, c, t, g, unknown, or other
  misc_feature (408)..(408): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (494)..(494): n is a, c, t, g, unknown, or other
  misc_feature (495)..(495): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
tcccccgggctgcaggaattcgcacgagaccattacctagaacatcctaatcgaaaaaccaccaccactggacgtcagcctagcaattacctcatccactccatattggagaactccacaccatgaaggcgctgatcgtttcccttgctctcctggcgctcgctgcgagcgccacctccactacatgcgggggctgtgcctgccagacaccaccgtttcatctaccgcctccgtactatatgccccctccgttctatctgccaccgcaacaccccccgcagccatggcaataccccactcaaccatggggnntgggggccntgtcatcatttcggatcctgctgcgtctgctgcctcggcagccccttcctgccccagtgcgtcgagttcctgaggcaggggtgggnnagcnnnagctacaccctacggctcgccacagcgccaggcgctgcagcaacagtgctgccaccaaatcaagcaggtggagccgtggnnggtggaccactcgacatactgtgtggtcctgcaatccttcctgcaccagcatccccagggcgagctcacagctctaatgacgccggtaggggnnnnnnnnnnnntggggnnnnnnnn

SEQ ID NO: 40341 - DNA, 671 bp, Zea mays
  misc_feature: Ceres CLONE 1432844-F
  misc_feature: Encodes the peptide sequence at SEQ ID NO. 40342
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
aagctggagctccccgcggtggcggccgctctagaactagtggatcccccgggctgcaggaattcgcacgagaccattacctaggacatcctaatcgaaaaaggagcccagtcaatgagcttagcacttctcgagggctactcctccgccgaggaggaggacggccccgccgccggcgccggcgccgagctaagcgagtccgctgattcgtcagccgaggaagccggatcggacggcgacgaggggtccgctcctccgaagtcggccttcaagccccgccgccgaccaaaccgtaagaagggagatgccggcggcggcgacggggactcctgtctgccctccgctctggaggccttcnnnnatatctcgggaccaccggagttcttgaggcacagggttgcggagcctgaggaagggacggaggccctcggtgtactcgatcgccgtgggaaagannnaagcaagctgccgcctccaggagctgttgtggtggcaaaaccgcagttggttaccacaattggagccaaccctccaggttcagtgaccnnnggttctgttgatggaaaaagaataataggtgccgcaaatcctggtccagaagatgcagctgatcttctgaggatgtgtctcccatgtggtgtacnnnnnacctactccatggcaagggtatg

SEQ ID NO: 40342 - protein, 185 aa, Zea mays
  misc_feature: Ceres CLONE 1432844-F
  misc_feature (82)..(82): Xaa is any aa, unknown, or other
  misc_feature (83)..(83): Xaa is any aa, unknown, or other
  misc_feature (114)..(114): Xaa is any aa, unknown, or other
  misc_feature (115)..(115): Xaa is any aa, unknown, or other
  misc_feature (145)..(145): Xaa is any aa, unknown, or other
  misc_feature (177)..(177): Xaa is any aa, unknown, or other
  misc_feature (178)..(178): Xaa is any aa, unknown, or other
MSLALLEGYSSAEEEDGPAAGAGAELSESADSSAEEAGSDGDEGSAPPKSAFKPRRRPNRKKGDAGGGDGDSCLPSALEAFXXISGPPEFLRHRVAEPEEGTEALGVLDRRGKXXSKLPPPGAVVVAKPQLVTTIGANPPGSVTXGSVDGKRIIGAANPGPEDAADLLRMCLPCGVXXTYSMARV

SEQ ID NO: 40343 - DNA, 656 bp, Zea mays
  misc_feature: Ceres CLONE 1432853-F
aagctggagctccccgcggtggcggccgctctagaactagtggatcccccgggctgcaggaattcgcacgagaccattacctagaacatcctaatcgaaaaacgagtgttctgcctcccgaatctcggtcgcgaagagactctccatctccgccgccgccatcatcggcgccaatctcgcgctccgctctgctccgcggcctccacgcccttggtgcccccacccccgtctcccgcccgggtgcctcccctgccccgttcacggtccccgcccccatccctcgaccggcgcgcatgtcgctgctgctgccacagcgcgtacgtgcccccgccccgtcgcgtcctcgccacatcggcgcgccccgtctgagttagcttcaggtctagcgacccgatctggaggcgggcaaaggcgtcacagacgaagatggacttgtctgcgtgcggagccgccgccgcaggcacctgcagtacgatgtcagtgggaatggacagctcggagtcgacggagagcagccccgagcgaaggagcagcgagaggtcgtgcaggaggagcgagagcgaggaggccaccatgtcaaggtcgctctttagccgcagccgccccccggggagcccagggtcctggcaccggacagagagcgcgtggagggaacg

SEQ ID NO: 40344 - DNA, 640 bp, Zea mays
  misc_feature: Ceres CLONE 1432857-F
  misc_feature (324)..(324): n is a, c, t, g, unknown, or other
  misc_feature (378)..(378): n is a, c, t, g, unknown, or other
tggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttcaaccctacangatccaacaggcaatcgcagctggcatcttacctttatcacccttgttcctccnaacatcatcagccctattacaacaagtacctttggtgcatttattggcacaaaacatcagggcaccacaactacaaacaacttgtgctagcaaaccttgcttgctactctcagcaaaaacagttttcttccattcaccacctaggttcattgaaacccgcctttctttttgccaaaaaaaaaaatttccttttaacccggtaccttggtggcctaaccccaaaaaatttttttcttttaaccaaattgggcaaatttgaaat

SEQ ID NO: 40345 - DNA, 675 bp, Zea mays
  misc_feature: Ceres CLONE 1432859-F
  misc_feature: Translation starting site: 231
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (18)..(18): n is a, c, t, g, unknown, or other
  misc_feature (37)..(37): n is a, c, t, g, unknown, or other
  misc_feature (38)..(38): n is a, c, t, g, unknown, or other
  misc_feature (73)..(73): n is a, c, t, g, unknown, or other
  misc_feature (75)..(75): n is a, c, t, g, unknown, or other
  misc_feature (77)..(77): n is a, c, t, g, unknown, or other
nnnggggggggccggggnggcaggccccccttccccnnataaaggcccctggggggggccccagggggggggngnangggggaggaggggggggcttcatacaccggctcccgcggggcgcaggttaccccacccgaccatgggcgagaacatcctaatcgaaaaaaccatattattgagaccaacaagcaacatagaaagtggaatccagtagcaacaatagagcaacaatggggaccaagatattttccctccttatgctccttgctctttctgcatgtgttgctaacgcgacaattttccctcaatgctcacaagctcctataggcttcccttcttcccccataccttccatcaatgatagcttcagtatgtgaaaacccagctcttcaaccctataggctccaacaagcaaatcgcagcaaggaaacataccctttatcacccttggtgcaacaatcgccgccctatctttggtgcgagcctttgggacaaacccatcagggggaaaggtagctgggagcaacccccgggggtaccctgggggaaccaacccaagggaggctccggggggaaaaaccttttttctccccccgaattcttcttgggggcgaaacaaacaaaattgttggtttttcctcgcttttttaaaaacaccagaaatggggtggtgtt

SEQ ID NO: 40346 - DNA, 685 bp, Zea mays
  misc_feature: Ceres CLONE 1432863-F
  misc_feature: Encodes the peptide sequence at SEQ ID NO. 40347
tggagctccccgcggtggcggccgctctataactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttccccctggccgggctgctgctggtgctgtcggggctggcgctgacggcctccgtggtggggctggccgtggccacgccggtgttcctgatcttcagccccgtgctggtccccgccgcgctgctcatcggaacggccgtcatggggttcctcacgtcgggcgcgctggggctcgggggcctgtcctcgctcacttgcctcgccaacacggcgcggcaaggcgttcccaccgcaccccggaactaacttggaaggaggcccacccgcagggataggcgggagcgccccccgccccaaccccggggccaaaaaaaaacccccgc

SEQ ID NO: 40347 - protein, 135 aa, Zea mays
  misc_feature: Ceres CLONE 1432863-F
  misc_feature (44)..(135): Pfam Name: Oleosin Pfam Description: Oleosin
MADRDRSGIYGGAHATYGQQQQQGGGGRPMGEQVKGMLHDKGPTASQALTVATLFPLAGLLLVLSGLALTASVVGLAVATPVFLIFSPVLVPAALLIGTAVMGFLTSGALGLGGLSSLTCLANTARQGVPTAPRN

SEQ ID NO: 40348 - DNA, 651 bp, Zea mays
  misc_feature: Ceres CLONE 1432869-F
  misc_feature: Encodes the peptide sequence at SEQ ID NO. 40349
  misc_feature (415)..(415): n is a, c, t, g, unknown, or other
  misc_feature (436)..(436): n is a, c, t, g, unknown, or other
aagctggagctccccgcggtggcggccgctctagaactagtggatcccccgggctgcaggaattcgcacgagaccattacctagaacatcctaatcgataaatcacagatcacacacactcgagaactccatttcgatctcatttgaaatcaacccatcctcgtttcgtttctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgagggtcaggtgaaggacttccagacccttcttctttggtgagaagangttgctgttgtttggctgcangaaccctgaagaaatcccatggggttcgggtggcgctgaataagtttgttggagctaccgggggttttccctgaaccggaagaggggtggcgcttcctttgagggtgggggccaaaaaggttgtcatttctcggtcctaacaaggaaacccccccatgttctttttttgggggtcccccaaaaagagaaaaaaaatcttaaaaacaaaaatttgt

SEQ ID NO: 40349 - protein, 72 aa, Zea mays
  misc_feature: Ceres CLONE 1432869-F
  misc_feature (4)..(71): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEGQVKDFQTLLLW

SEQ ID NO: 40350 - DNA, 659 bp, Zea mays
  misc_feature: Ceres CLONE 1432877-F
  misc_feature: Encodes the peptide sequence at SEQ ID NO. 40351
  misc_feature (463)..(463): n is a, c, t, g, unknown, or other
  misc_feature (464)..(464): n is a, c, t, g, unknown, or other
  misc_feature (546)..(546): n is a, c, t, g, unknown, or other
  misc_feature (570)..(570): n is a, c, t, g, unknown, or other
ctggagctccccgcggtggcggccgctctagaactagtggatcccccgggctgcaggaattcgcacgagaccattacctagaacatcctaatcgaaaatgacatatgagggtgccgttgatttggagaacatggatgatatgttacaaaagtccgctattgaggaccaaattgcaaattttggacaaacaccaattcaaatttttcggaagaaacacccaaggagaggtcctcctataccaattgtgcatccactatattttgcgccacaatcgataacagtgacttctgttgtcccgaccatagtcacccctttatctgtattattcattggtttgttggactcaaacgttgtcatgatgaatgaggggctcatactctctgtaaagctttggctaacaacacagttgcagtctggtggaaacttcacattttctggatcactggaacctttcttcgaattnnggtctgatgttatttctccgaagaaaattggcacttctttggctgaaaaatgtgagtttggaaagacatgcttagcaactgntcaaattcgtggtgacaattactnaattttgtgtggtaatggggagaatagtttcagatcatatctctaagtaatggaaaaattgtgcagagcatccggcagcataaagatgt

SEQ ID NO: 40351 - protein, 172 aa, Zea mays
  misc_feature: Ceres CLONE 1432877-F
  misc_feature (122)..(122): Xaa is any aa, unknown, or other
  misc_feature (123)..(123): Xaa is any aa, unknown, or other
  misc_feature (150)..(150): Xaa is any aa, unknown, or other
  misc_feature (158)..(158): Xaa is any aa, unknown, or other
MTYEGAVDLENMDDMLQKSAIEDQIANFGQTPIQIFRKKHPRRGPPIPIVHPLYFAPQSITVTSVVPTIVTPLSVLFIGLLDSNVVMMNEGLILSVKLWLTTQLQSGGNFTFSGSLEPFFEXXSDVISPKKIGTSLAEKCEFGKTCLATXQIRGDNYXILCGNGENSFRSYL

SEQ ID NO: 40352 - DNA, 668 bp, Zea mays
  misc_feature: Ceres CLONE 1432882-F
aagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctcgatgc

SEQ ID NO: 40353 - DNA, 940 bp, Zea mays
  misc_feature: Ceres CLONE 1432892-F
  misc_feature: Encodes the peptide sequence at SEQ ID NO. 40354
ggtgttggcatctcttctatgtttctgccgttctacctcttggcagtggtgtactccccgcggggggggccgctctagactagtggatcccccgggctgcaggaattcgcacgagaccattacctagaacatcctaatcgaaaaatgtcaccgtagtgccatgtcatcctgatcccagatccatcgtcgccgccccgctggtgatgaacagctcgtctgggggcagtgtcatgaccagctcctatggcggcggctgcggctgcggtggcaccatgagcggttacctggggtcctactactcgttcccgtcctcctgcgtgtcggtggccggggagcggtcctcctcatcagcgtcctcctgtgtgggccaccattacccgacgccgcaccacgtggagccttgattgctagtagcttgtttgactagagtggcgcgacttgtatatgggaagagcgacgctgggccccccaacccctggccacggatgaggtgcggccctccttggatccgaaattcgcagtctggcaagccgttaatcatcccttctcgtcgccaccctttgtgagtgttatattcgaaatcacctcaaagtctacacctagagtaatttcctgccctaccggagcgttttggacaagaacacttcacttatggattgcgcgttacgggtaaccgtcctaaacgggaaataacggtttgtgtgtggtgagcatggtccttcccccaccggtacacattccgagccaatgggatggtgcctttctactcttccttgtgttccgggttcgggggttccctggcccctatagttgtgccgaattgaaggaaccaggcacactggcggctctcaattgttggttcggattggtgtttgtatataattgagggaaccggcgtggctaccgtagtcccctcctcactgtgttatgaataaatttg

SEQ ID NO: 40354 - protein, 66 aa, Zea mays
  misc_feature: Ceres CLONE 1432892-F
MNSSSGGSVMTSSYGGGCGCGGTMSGYLGSYYSFPSSCVSVAGERSSSSASSCVGHHYPTPHHVEP

SEQ ID NO: 40355 - DNA, 684 bp, Zea mays
  misc_feature: Ceres CLONE 1432904-F
  misc_feature: SWISSPROT Homolog: EC 3.1.3.36 Phosphoinositide 5-phosphatase
  misc_feature (335)..(335): n is a, c, t, g, unknown, or other
tctagaactagtggatcccccgggctgcaggaattcgcacgagaccattacctagaacatcctaatcgaaaataaagaggggtgtgaatgaggagggcagagtagcaaatgatgttgagactgagcaaattgtttatgaagacatgcttggaccatggcaaataagctctgttgtgcagaacaggggttcgattccactattctggtcccaggagacatcaaagctgaatcttaagcctgatatcatattgcatggaaaggacaaaaattatgaggctaccaggcttcattttgaaaatcttaggaaaagatatggaaatcctatcatcatcttnaacttgattaagacacgtgagaagagaccacgtgaaatcatactccgtcggaattttgacggaagcataaggattattagtagtggtctaccaggcgaggatcatttgagaaatttacattgggatcttcctaagaactcccaagcaaaagttcaaatgccccttcagggcttttggagggggggattttgaccttttaaccttaacaaattttttatcggccagtttccccggcccaaagggggaaaaattccccaatttaacccctaaccgaaaaaagggtttgggcccccggtggggaaaaaaaacccaattttgggcacgccaaacttttttttaatcttttttt

SEQ ID NO: 40356 - DNA, 803 bp, Zea mays
  misc_feature: Ceres CLONE 1432908-F
  misc_feature: Encodes the peptide sequence at SEQ ID NO. 40357
  misc_feature (41)..(41): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (598)..(598): n is a, c, t, g, unknown, or other
  misc_feature (638)..(638): n is a, c, t, g, unknown, or other
  misc_feature (641)..(641): n is a, c, t, g, unknown, or other
  misc_feature (655)..(655): n is a, c, t, g, unknown, or other
gggggggggtggggggggcgcgggcgcgcgtcccgccatancgnnnnagngccccagaaaagctggtgctccaccgcggtggcggccgctctagaactagtggatcccccgggctgcaggaattcgcacgagaccattacctagaacatcctaatcgaaaaaaaccaaaagcacggccatctctctactcactcttcctgtctcctcgtcttgctggagccagtattaacagatccgggttcgagcgttcagtctcgccggacctccgactgggggtcgctgctatctctctggtaccgcggtctcttgcgcgcttctctccattcgctcccactcaccggcttgggggaatgaaggatgtggtagggagcccggggacctggagtggcatggcgctgcggttgtcgcaatgcgtgtccgctggcgcatccatgggcgctatggccacagcgtacggcttctccaagtacactgctttctgctacttgattgcttcaatgggccgacaacttctttggagttttggccttgcttgtcttgatgtctactctttgaagactaaaagagatcttaacaacccctgtgctttgtaagcctnttttgttgttggggaactggggtcactggaaattccagtncgnttggctgcccccgnccggccgtccggcgggccttgaaccattccttgttcccaaaaggggaacgtcccgccttcgtgccggggatgggacccccgcacatttgatgcggggccggccccgataagcgcccccttcctcggcgtgggttgcgcttggcagatt

SEQ ID NO: 40357 - protein, 80 aa, Zea mays
  misc_feature: Ceres CLONE 1432908-F
MKDVVGSPGTWSGMALRLSQCVSAGASMGAMATAYGFSKYTAFCYLIASMGRQLLWSFGLACLDVYSLKTKRDLNNPCAL

SEQ ID NO: 40358 - DNA, 717 bp, Zea mays
  misc_feature: Ceres CLONE 1432927-F
  misc_feature: Encodes the peptide sequence at SEQ ID NO. 40359
  misc_feature (451)..(451): n is a, c, t, g, unknown, or other
  misc_feature (472)..(472): n is a, c, t, g, unknown, or other
  misc_feature (524)..(524): n is a, c, t, g, unknown, or other
  misc_feature (597)..(597): n is a, c, t, g, unknown, or other
tccccgcggtggcggccgctctagaactagtggatcccccgggctgcaggaattcgcacgagaccattacctagaacatcctaatcgaaaaattattcgctcctcccgaccgccgccgtcgccgcctcctctccccagcacccggagctcgaccgaacgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaaccctccgtctgagatcgtgcctgccacgctcaagaagtctngcaagccaccctggccgcccnattggctctggccctcctggtgaccgcccaaggggcccaagccgttttgacngcgacaggccaagggtttggtgacagggatgggtacccgtggtggtccttcgtggggctccctggtgactttnggtggcgattagagtggagcttcctgctgagatccagccatcattcaggaggccttggctttgggcctggtggcggcagcggcttcggggcggggcccaacctcttcttcatggaatgag

SEQ ID NO: 40359 - protein, 108 aa, Zea mays
  misc_feature: Ceres CLONE 1432927-F
  misc_feature (3)..(98): Pfam Name: S10_plectin Pfam Description: Plectin/S10 domain
  misc_feature (95)..(95): Xaa is any aa, unknown, or other
  misc_feature (102)..(102): Xaa is any aa, unknown, or other
MIIPKKNRNEICKYLFKEGVLYAKKDYNLAKHPQIDVPNLQVIKLMQSFKSKEYVRETFSWQYYYWYLTNDGIEHLRNYLNPPSEIVPATLKKSXKPPWPPXWLWPSW

SEQ ID NO: 40360 - DNA, 678 bp, Zea mays
  misc_feature: Ceres CLONE 1432930-F
  misc_feature: Encodes the peptide sequence at SEQ ID NO. 40361
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
aagctggagctccccgcggtggcggccgctctagaactagtggatcccccgggctgcaggaattcgcacgagaccattacctagaacatcctaatcgaaaaaattgaaaacagggccttggtcgagttaaaaaaaacgcgagtgaaacacactgacaccgcaaacacgccaaccggcctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacgggggagcttccagctccgacgccaaggagaacgccgatcccaaccccgagccacaggttgaggtggagatagagtacgtgccggaagaagccgagcttgacgaccctctcctggatgatttcaggccatcttcgagaaagtcaccttcaggacgctgctgcannncgcggcgaagatgataataaagacgagggtgccgctgatgcaacaagaaggggtccctggatgatgatgaccaccacaaaatgattggccggaggcaaacaaaaaaagggcggaggccttccaaaagaaaaaaaa

SEQ ID NO: 40361 - protein, 113 aa, Zea mays
  misc_feature: Ceres CLONE 1432930-F
  misc_feature (109)..(109): Xaa is any aa, unknown, or other
  misc_feature (110)..(110): Xaa is any aa, unknown, or other
MAAAAEVDPSPNPPPTTASGLSKTKTREADRRRRRRSKAKKNKSVTEADAQDADGGASSSDAKENADPNPEPQVEVEIEYVPEEAELDDPLLDDFRPSSRKSPSGRCCXXRRR

SEQ ID NO: 40362 - DNA, 702 bp, Zea mays
  misc_feature: Ceres CLONE 1432932-F
  misc_feature: Encodes the peptide sequence at SEQ ID NO. 40363
aagctggagctccccgcggtggcggccgctctagaactagtggatcccccgggctgcaggaattcgcacgagaccattacctagaacatactaatcgaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccagtagctctgggcaaacttttcttcctactctcagcaacaacattttcttcaatcaacccactgtctacactgaaccctgctgcttatttgcggcaaccactataaccattaagccggttagttactgtctactttaagaaaaaaaattttttcatttaaccattggcccccctgaaccccgttgtttttttgccccccaaaaccttctccctttgcccgg

SEQ ID NO: 40363 - protein, 105 aa, Zea mays
  misc_feature: Ceres CLONE 1432932-F
MATKIFSLLMLLALSTCVANATIFPQCSQAPIASLLPPYLPSIIASICENPALQPYRLQQAIAASNIPLSPLLFQQSPALSLVQSLVQTIRAQQLQQLVLPLINQ

SEQ ID NO: 40364 - DNA, 696 bp, Zea mays
  misc_feature: Ceres CLONE 1432938-F
  misc_feature: Encodes the peptide sequence at SEQ ID NO. 40365
tggcggccgctctagaactagtggatcccccgggctgcaggaattcgcacgagaccattacctagaacatcctaatcgaaaaacgatcacacaccactccacatcattagcaagagggatagagcaaggccacacacacacacacaccactaggctagcctagccttttagtcatccaggaggagcaagaagggcgcgcacgcaagcaggcaagcaagaagagagccgatcgaccgagagctagcacgcgatggcgaggtcttccaagatgatggtggcggcagctctgctggccttggccctggccgtgtctatcgcctaggcgaggaacatcaagaccacaacgacggaaaataaggacgacgcggtggtgcagccgcataccttcccgcccttcgaccgcctcgacggcggcgcgtccccggtgttcggaggcctccccggcggcagcattcttggcagcagccttcccgggttcagcatgcccagcagcgtctgcagcctacccgggttcagcttgcccggcagcggcagcatgcccctcttcagcggcggctccccggtcttcaacggcttcagcggcctgcccggatcccccaccgacggctccatccccaagcacgccaactatccctgaacacctaccagcgcggcatgacagtgttgctactgaatctgtacaacgtcgtcgactac

SEQ ID NO: 40365 - protein, 51 aa, Zea mays
  misc_feature: Ceres CLONE 1432938-F
MPSSVCSLPGFSLPGSGSMPLFSGGSPVFNGFSGLPGSPTDGSIPKHANYP

SEQ ID NO: 40366 - DNA, 727 bp, Zea mays
  misc_feature: Ceres CLONE 1432939-F
  misc_feature (429)..(429): n is a, c, t, g, unknown, or other
  misc_feature (432)..(432): n is a, c, t, g, unknown, or other
  misc_feature (442)..(442): n is a, c, t, g, unknown, or other
  misc_feature (473)..(473): n is a, c, t, g, unknown, or other
aaagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgcaaagctgtgctgtgcgccagctgctgcttccctacngcngctccagtcncggacggagaagtgcaggtgcttgcctgccngcagcatctcccacgcttgccgaggcgtcaggatcttcgtcgcagggcccgggcggtgcaatctttagttggtcggcctcaaccagaagcggggaaaggcgggctttgtaatttttcagggcccgtcccaccttggggttcggggttctcaacgggcccccctgaaaccccccccgcccccccccttcaaatttccctgggaaaaagtgtgatctccacatgggccgggaaaaaaaattccctttccccaaaag

SEQ ID NO: 40367 - DNA, 710 bp, Zea mays
  misc_feature: Ceres CLONE 1432940-F
  misc_feature: Translation starting site: 185
  misc_feature (374)..(374): n is a, c, t, g, unknown, or other
  misc_feature (447)..(447): n is a, c, t, g, unknown, or other
  misc_feature (615)..(615): n is a, c, t, g, unknown, or other
tccccgcggtggcggccgctctagaactagtggatcccccgggctgcaggaattcgcacgagaccattacctagaacatcctaatcgaaaacttttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcngtgagcgccttacaaaactcctcatgatgcacgggcgcaaacacgcaagaaggtcatggctgtccgcatcatncagcataccctgaagatcattcacctgctcacggatgcccaccccatccaggtcgtcgtcgacgcgatcattaacgggggccccgggaggaatgccacccgaattggttccctggggtttgaaaaaggcagccctggatttcctcccccccgaggagggggaacaggncttttaccctcctacccctggggccggggaaaagtttttcggaaaaaaaaaccttttccaaggctcttaaaaaaaacaaaaaaccctctccaggc

SEQ ID NO: 40368 - DNA, 724 bp, Zea mays
  misc_feature: Ceres CLONE 1432957-F
  misc_feature: Encodes the peptide sequence at SEQ ID NO. 40369
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaacccgttccaactcctacctacgcagcagaggccagccacctccccgtcgctctcacgctcttcgtgcccgccgcctctcctccgtctctgcctctctccctctcccctcccgtctgacgcacatggcctccatcgccggatcttcggccctctccttcgccaggcccgtcaaggcaatcaacacaaattctctagctttctccccggcgaggaagggcaacacattcctccgcctgcaaccaatgcctatgagatctgtttcctgcgctgccaagaaggatacgacagacaaggtttgtgagattgtgaagaagcagcttgctcttcctgaacatactgaaagtttgcgtgaatcgaaattctcgtgactcggtgcagattcctggacccggntgaattgtgatgagtctcgaggagcacttcgatttaagctggaaggaggcagcccccaaacatccgcacaattgaagaacccccggaactcatcaaaaactttgttgtgggaaaactaatttcgaacctccctcttcgtttcccacccactgggggcttaccctggataagggttttaggggccaaaaaatttggaattttcccccaggggttgggctcccccgggtct

SEQ ID NO: 40369 - protein, 81 aa, Zea mays
  misc_feature: Ceres CLONE 1432957-F
MASIAGSSALSFARPVKAINTNSLAFSPARKGNTFLRLQPMPMRSVSCAAKKDTTDKVCEIVKKQLALPEHTESLRESKFS

SEQ ID NO: 40370 - DNA, 710 bp, Zea mays
  misc_feature: Ceres CLONE 1432958-F
  misc_feature: Encodes the peptide sequence at SEQ ID NO. 40371
  misc_feature (397)..(397): n is a, c, t, g, unknown, or other
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttccctttctcccccataccttccatcaatgatagcttcagtatgtgaaaacccagctctttcaccctataggctcccaacagcaatcgcagcaagcaacatacctttaatcacccttgtttcacaatcngcaggcctatctttggtggcatcatgggtacaaacatcaggggacagcagctgcagcaactcctgctacctgggaacaacaagtaactctgggaaacctttttcccctaatcttagaaaaacaaattttttccaattaaccaaatggctaaatttgaacgcggcgtgcttaatttggccaaacaaaattttcacttttcgcccgttaggtattggctaattttcagaaaaaaaaaatttttttcaatataacccaattgggccccatgaaaacccgcttttttttttttggggccaaaatttcccttcccttt

SEQ ID NO: 40371 - protein, 148 aa, Zea mays
  misc_feature: Ceres CLONE 1432958-F
MATKIFSLLMLLALSACVANATIFPQCSQAPIASLSPPYLPSMIASVCENPALSPYRLPTAIAASNIPLITLVSQSAGLSLVASWVQTSGDSSCSNSCYLGTTSNSGKPFSPNLRKTNFFQLTKWLNLNAACLIWPNKIFTFRPLGIG

SEQ ID NO: 40372 - DNA, 1043 bp, Zea mays
  misc_feature: Ceres CLONE 1432962-R
tgtccggggcccccctcgaagtcgacggtatcgataagcttttttttttttttttttagagagacagcaagcctttatgatcttcaaattgataagacaacacatagcaggtttatagcggacattgaaatggataaacaccaacaaaaaaaaaagaaagaccgaacaaaaaaagaaaaaaaaaatcaagcaaagagataaaaagatgattgatggttcgacccgccagaaatatgatgaatgaataaaaaaaagccttttggagataaagctaatttggcaagcgaacgaacgacatcttaaggaaacatatagacgaaacaaacccctagaaacttaggcaggtcaatcaaaaaaatttgttactactggttcctcaaaccgccttggagatgatgcttcctttgaacccccccccagcatcatcatccctggaatgttcgggatgtcccaaaaaaagaaggggtggtcacccggaaaaaacccgcctggatccaagagggggcgtgggctttttgttcggaaattcttttcccctcaaatagtggttcccaaacgacgagcctaattgcgctttgatattaaaaaaaacccctgtttttagggccgaaggccctttcccagggccaccccatcgtcccgggggaaaaggtttaaaggggactctccgcgcgtttaaggagaaataacaccgcggcgagtaaagattctcaataccgctccacaaacccccgaaaaaacagagagatattctcggaggggcgaaaattctggagaaaacaaacaacgctccatgacaatgttggtgaaaatattatcgccgctagagagaagaagaattggttgttatagtctactaaaggcagagagtctattgtctctgtcaaaggaggcagaagatactcatcaccctctcagagaagcaagtgtccggatgaaatgttgacgcccccataagatgatcccgaacgtgtgaaaatatccgccgcacacgagaatcatagtggggtagaagacacctccttcaataggtagttcacgtt

SEQ ID NO: 40373 - DNA, 706 bp, Zea mays
  misc_feature: Ceres CLONE 1432965-F
  misc_feature: Translation starting site: 237
aaagctggagctccccgcggtggcggccgctctagaactagtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagaggacaaggtggtgtacggcaccgcggacctcgggcggccgtgcgcgccgttcgccaagaacgcgtcggagatgcacggcttcacgcagggctgcctgaccctgcgcaggtgggacgagctcaacgccttcttccagaaatctgggtttttagatcagcttgggatgtcagcaaagtatgacacgaagagctactgcagacagagtttga

SEQ ID NO: 40374 - DNA, 604 bp, Zea mays
  misc_feature: Ceres CLONE 1432967-F
  misc_feature: Encodes the peptide sequence at SEQ ID NO. 40375
  misc_feature (20)..(20): n is a, c, t, g, unknown, or other
  misc_feature (58)..(58): n is a, c, t, g, unknown, or other
  misc_feature (59)..(59): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (71)..(71): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (99)..(99): n is a, c, t, g, unknown, or other
  misc_feature (289)..(289): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (347)..(347): n is a, c, t, g, unknown, or other
aaagctgggagctccaccgncggtgggcggccgctctagaactagtggaatcccccgnnggnnncnttggnccaaggggnnnaaaaatttttcgccccnaacgaagaccattacctagaacatcctaatcgaaaggcgtcgctctgtatttttctctcctcactcaacgcggcgatgccccctagatcggatcacgccgccggcagcggcgccgcggcggcggccacgcaggcccacttcgactccatcgatccactcttcatgtgctccgcgtgctacccttctcttncnnntctgcgcgcgcacccgctgaagctgccgtcgaacctgcgcttcctctccatgancgtcttctcctcatctggtcactactttgcgtcgtctcggactgtgtacacgtcatcgtgagcccctgggatcggagcggccagaacccgggatgggggcgtcggcccgttgtttcttccaggggggttaagggcagtaatattaagggactccccccgggttcaggtccccctggggggtttggcacactcctcaaaactccctaaaaaccaaaagcccggaaccccccgttttttttgagaccccgccccccccc

SEQ ID NO: 40375 - protein, 77 aa, Zea mays
  misc_feature: Ceres CLONE 1432967-F
  misc_feature (39)..(39): Xaa is any aa, unknown, or other
  misc_feature (40)..(40): Xaa is any aa, unknown, or other
  misc_feature (58)..(58): Xaa is any aa, unknown, or other
MPPRSDHAAGSGAAAAATQAHFDSIDPLFMCSACYPSLXXLRAHPLKLPSNLRFLSMXVFSSSGHYFASSRTVYTSS

SEQ ID NO: 40376 - DNA, 695 bp, Zea mays
  misc_feature: Ceres CLONE 1432968-F
  misc_feature: Encodes the peptide sequence at SEQ ID NO. 40377
  misc_feature (612)..(612): n is a, c, t, g, unknown, or other
caaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccaccntcggcgtccgcggctcctagccgggccgccctgagccgccgccgcgccgcaccgtcgcagcttccgctggcagcagctgcagc

SEQ ID NO: 40377 - protein, 113 aa, Zea mays
  misc_feature: Ceres CLONE 1432968-F
  misc_feature (103)..(103): Xaa is any aa, unknown, or other
MLLTSCRQGRGMASLSCARADGVVRSGALPAKLLLCASCCFPTAAPVADGEVQVLACRQHLHRLPRRQDLRRQRPRRRHPQLVGLHQQPRQRGLVAVQRRVHXRRPRLLAGPP

SEQ ID NO: 40378 - DNA, 721 bp, Zea mays
  misc_feature: Ceres CLONE 1432972-F
  misc_feature: Encodes the peptide sequence at SEQ ID NO. 40379
aaagctggagctccccgcggtggcggccgctctagaactagtggatcccccgggctgcaggaattcgcacgagaccattacctagaacatcctaatcgaaaaatcgcaagaaaaaggaaatcaaaacaaagtaaagtggggggaaaagcatggcgatagctcttctcccatccgttcgtcttcttccacaaagtctctccagaaggccaccaccaacctcgtcgccattatccgttcgccgcccacggccaagagcccttcccctccctcgcgtccactgccgcgccggccggaccccggaccccctcaccgctgctagggaggctgctgccttttgggctgggaagctcgccggcgctgtgccatggaaggccgcggtctccggcgtggtcgccctcgccgtctccttcacctgccttgttggtttggccaatgccagaactggggtaaacaaaccagaattgcttcctaaagaatttactaccgtcatcgatgttgctggttttctctcgtcaggccaggaaaaccgtttgcgccaagagatagaagacctggagaaagatacagggtacaaactgcgagttcttgcacaaaattatcctgatacacctggattggctatcaaagatttttggcaggttgatgagcgtactattgtttttgttgctgatccaacctttggtaacataataaattttaacattggtccattagttgattt

SEQ ID NO: 40379 - protein, 190 aa, Zea mays
  misc_feature: Ceres CLONE 1432972-F
MAIALLPSVRLLPQSLSRRPPPTSSPLSVRRPRPRALPLPRVHCRAGRTPDPLTAAREAAAFWAGKLAGAVPWKAAVSGVVALAVSFTCLVGLANARTGVNKPELLPKEFTTVIDVAGFLSSGQENRLRQEIEDLEKDTGYKLRVLAQNYPDTPGLAIKDFWQVDERTIVFVADPTFGNIINFNIGPLVD

SEQ ID NO: 40380 - DNA, 677 bp, Zea mays
  misc_feature: Ceres CLONE 1432975-F
  misc_feature: Encodes the peptide sequence at SEQ ID NO. 40381
  misc_feature (428)..(428): n is a, c, t, g, unknown, or other
  misc_feature (483)..(483): n is a, c, t, g, unknown, or other
tggagctccccgcggtggcggccgctctagaactagtggatcccccgggctgcaggaattcgcacgagaccattacctagaacatcctaatcgaaaaattacttactggtcctcactcccacaccaaccaaccaacctcctctgcctgccgcttctcctgctgcgggcggtcacggctgcaagtactagaggaggacatccgcttccattactgcgcctgcggaggatcggaggaaccagtagcggaggcttcgactttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgcccagtggtccctccnaaaggttcacccctgccccccaccgttaaaaagaaaccccctttccccccccccngggtcccccgtgggaaaacacccaaaaatccctcctaaaggggcacctttttgttattcccccccccgggaagaacctctcccaaatttggggccccccctaaaaggggaggggaattttcccctttgtgtggggtggggggggccccaaaaaaaaataaaccccccgcggaaattccgcgcgcctacaaaagt

SEQ ID NO: 40381 - protein, 57 aa, Zea mays
  misc_feature: Ceres CLONE 1432975-F
  misc_feature (49)..(49): Xaa is any aa, unknown, or other
MARRAASSLVSRCLLARAPAGAPPAAPSALRRTVPADGMHRLLPSGPSXRFTPAPHR

SEQ ID NO: 40382 - DNA, 698 bp, Zea mays
  misc_feature: Ceres CLONE 1432978-F
  misc_feature: Encodes the peptide sequence at SEQ ID NO. 40383
aagctggagctccccgcggtggcggccgctctagaactagtggatcccccgggctgcaggaattcgcacgagaccattacctagaacatcctaatcgaaaaataaacaactcgaccaaacccaagtccagacccgcagctcccgtcagccgccggaggcggagggaaccgagccggcgaccggcagaccgcagagaagaggccagaagccgaccgcaggcagccgccaccgcaccaaaacccgaggtctcgaggcaatcgagcgcgcgcgggtcgggggctgcggccatgtcggtgagttgcgggctcgagtgggtggtgtgccttggctgcacgcggtgggcgtggaagcggctcacctacatcggcgcctacgacagcgagacgtggccgccggcgtccgccgacgagttcgagcccgtcccgcgcctctgccgcgccgtgctcgcgaactacgacgaggagctctccagccccaagttcgcgccgccggagcacggctacttcgacatcgaccccaagggcatcctcaagcgggctacctacaaggaggtcggcaacgcgtgcccgccgtacctcgtctacgtcgacgaggcgcacaaggagatcatcctcgccgtgcgcggcctcaacctcgtgcgcaacgccgactacaaggtgctcatggacaacaagctcgggatgcagatgttcgacggc

SEQ ID NO: 40383 - protein, 137 aa, Zea mays
  misc_feature: Ceres CLONE 1432978-F
  misc_feature (6)..(74): Pfam Name: Lipase3_N Pfam Description: Lipase 3 N-terminal region
MSVSCGLEWVVCLGCTRWAWKRLTYIGAYDSETWPPASADEFEPVPRLCRAVLANYDEELSSPKFAPPEHGYFDIDPKGILKRATYKEVGNACPPYLVYVDEAHKEIILAVRGLNLVRNADYKVLMDNKLGMQMFDG

SEQ ID NO: 40384 - DNA, 882 bp, Zea mays
  misc_feature: Ceres CLONE 1432982-F
  misc_feature (43)..(43): n is a, c, t, g, unknown, or other
  misc_feature (45)..(45): n is a, c, t, g, unknown, or other
ggggtcgcgtttttggtttcgcgcagagaagtagttttttttntncaaaactggactccccgcggtggcggccgctctagatctagtggatcccccgggctgcaggaattttcacgagaccattacctagaacatcctaatcgaaaaacaggctcatctcgctttggatcgattggtttcgtaactggtgagggactgagggtctcggagtggattgatttgggattctgttcgaacatctgcggaggggggccatggcgaccgcggggaaggtgatcaagttgcttactgtgttggtatggcaggccggcataccactgtcgatcggaggaggtgtaggtagcgtcctccttcaggctaatggatctgcccttgatgatccttctttgacgtccgctcgcccaacacaacgtctacctgcgggggagggcggaggggtataactttacgtgtttcccgctcggatccgttgggtctattacacccccgagtgttttttaatgtaatgtggttgcggataaagcgctactacaagaacagtaattttccgtgggcgcgcacaacttgtccctttcccctggtagttttccccttggaaaattgtgatgagggggatattcttcctcctcccccaagctcccccgtctaaatattatagcgttggtggcggagtggtggttgcgggagtctataaatctaacctcgctatttgtgtgatacgttctggcttaattacgcatcctctagcgctcttttcccgcccgcgggggtgggctggcgtttctcgtattgttttggtggggactttgaacctttttaagggcggcgaaccgccgcctgccgacgtggggtttttgtctgcgttatattagcgcatttgcg

SEQ ID NO: 40385 - DNA, 799 bp, Zea mays
  misc_feature: Ceres CLONE 1432985-F
  misc_feature: Encodes the peptide sequence at SEQ ID NO. 40386
  misc_feature (1)..(1): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (799)..(799): n is a, c, t, g, unknown, or other
ntttttttttttttttttttgtttggnnnnnacgaannnnnnntcacgctggagctccccgcggtggcggccgctctagattagtggatcccccgggctgcaggaattttcacgagaccattacctagaacatcctaatcgaaaactctcgctcgccaggagaagcagccgccgttgctgctgccgcgtccacagaatggggggtttcgtgaagacccgtaacaccgatgcgtatttcaaacgtttccaagtgaaattcaaaagaaggcgggctggcaagacagactacagggccaggataaggctgattaaccaagacaaaaacaagtacaacacacccaaatacagatttgttgagcgatttaccgacaaggacatcactgcacaaatcatatctgctagtatagcgggtgatatggttcttgcttctgcctactctcatgagttgccactatatggtcttgaccttggtctgacgaactatgcagctgcctactgcactggacttctgttggctcgccgtgagctaaagatccgtggtctggataaggagtatgagggcaaggttgaggccactggcgaggacctccctgctgagcccggtgatgagaggaaccgccattccgtggctctcttgggaaggttgggccttagtcaggaatcaaaataggggaacccgtggtcatgggggcgccccccacgcggagagctttggcgatgggggggcctgggatcatttcctccaacagccaaggaaagagggtccggccttggcattccgagcaaagggggggaccan

SEQ ID NO: 40386 - protein, 157 aa, Zea mays
  misc_feature: Ceres CLONE 1432985-F
  misc_feature (27)..(154): Pfam Name: Ribosomal_L18p Pfam Description: Ribosomal L18p/L5e family
MGGFVKTRNTDAYFKRFQVKFKRRRAGKTDYRARIRLINQDKNKYNTPKYRFVERFTDKDITAQIISASIAGDMVLASAYSHELPLYGLDLGLTNYAAAYCTGLLLARRELKIRGLDKEYEGKVEATGEDLPAEPGDERNRHSVALLGRLGLSQESK

SEQ ID NO: 40387 - DNA, 676 bp, Zea mays
  misc_feature: Ceres CLONE 1432988-F
  misc_feature: Encodes the peptide sequence at SEQ ID NO. 40388
gctctttactagtggatcccccgggctgcaggaattcgcacgagaccattacctagaacatcctaatcgaaaaaacaacacagcccccggggccacagggcgcaggcccgcagccatggaccaggaccacaagaggctagtactcccgtcgccggcgccgcagtccccgccggcatccgccgcgtcggcgtcgaccacggcctcgccgtactccgcgctacaccctctcctcttgccctccccgaacccgcacctcttcctgaagcccaagacgctaactctctccctctcgtcctcctccctcacctccatgtcctcctcctcgctgcccgcccccgtcaccgatgtctgggaggtcgtcacccccactgccccatctgttgaccacgcggacggcgggcttgatgactgcgccatcttcccgccgcggctgcatgaggggctgggcctggacggcgagcccgaggaggtcccgccgatgccagcagtggcgaaggaggagaacgaggaggatggtgaatacgagggggaggactatgagtggctgtggggatgggagaggtgcaacttggcggcgaagcgcgcttgggcggccggtgtcgggatcgttcaggagcgggtgctcgtgcatggcgcgtgggggtgcccggctgtgaggcccgccgtgtggccgttt

SEQ ID NO: 40388 - protein, 187 aa, Zea mays
  misc_feature: Ceres CLONE 1432988-F
MDQDHKRLVLPSPAPQSPPASAASASTTASPYSALHPLLLPSPNPHLFLKPKTLTLSLSSSSLTSMSSSSLPAPVTDVWEVVTPTAPSVDHADGGLDDCAIFPPRLHEGLGLDGEPEEVPPMPAVAKEENEEDGEYEGEDYEWLWGWERCNLAAKRAWAAGVGIVQERVLVHGAWGCPAVRPAVWPF

SEQ ID NO: 40389 - DNA, 747 bp, Zea mays
  misc_feature: Ceres CLONE 1432989-F
  misc_feature: Encodes the peptide sequence at SEQ ID NO. 40390
aagctggagctccccgcggtggcggccgctctagattagtggatcccccgggctgcaggaattctcacgagaccattacctagaacatcctaatccaaaaatccggccgcgggtttcgaaaaaccaaagatatctcgctcttgatcacgctgagggcttgagggggaattctttctaccagcctccgctcacccgtcgtatcgatcgtccgggcgcgagggctcgccgggggcgctccggtccgtggaggaggacccactcgtccctctggtgcaagtctggagcagcgccgccttcgaccatgatgccgcctccgcctccgcgtggaaggccaattccgctgcgccttccatgtgctgcgagggagagaggtataagtaccggccctatgccgaccttgatgttgatgtccaccaccttcaggctcacatttacggcttcgaggccgaaatgctacgtctgtgtgcctgcctgcaccacgtctgtacctccgatgagaaagagtcgcgcaatcctggacaagtccccggggacgtcgactgcgtgggctcagtctggggtcacctacgactcgccagatggccggcgatttcaaacccgctacacccacaattcaacattccgagccgccgggctcgggatttggacaaagccctttaaaggaagggccccggccggactcctcgaaaggcttgaacttcccggccttccggcccccttccaaaaacggttccccccggaaaccct

SEQ ID NO: 40390 - protein, 102 aa, Zea mays
  misc_feature: Ceres CLONE 1432989-F
MCCEGERYKYRPYADLDVDVHHLQAHIYGFEAEMLRLCACLHHVCTSDEKESRNPGQVPGDVDCVGSVWGHLRLARWPAISNPLHPQFNIPSRRARDLDKAL

SEQ ID NO: 40391 - DNA, 771 bp, Zea mays
  misc_feature: Ceres CLONE 1432991-F
  misc_feature (21)..(21): n is a, c, t, g, unknown, or other
  misc_feature (22)..(22): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
gggggggcggggtgggggggnnttgggggggggannttcaannanntcaagctggagctccccgcggtggcggccgctctagaatagtggatcccccgggctgcaggaatgcgcacgagaccattacctagaacatcctaatcgaaaaggttttacgtccccgctgccaattcacgctctctcgagctaagttcttccctccgtcgccggcgccgggcgtgctcccgcgggatgctgcgtgcggtgcggtacctgctgggggcgccgggcggaggagggtttgggacaaggcagattggggaggaggggatactggatctgggagcgaaaacggttatatccccaggcgcctctcagggtattgggcggcaaaccgcgagagagttgacaaagcgtgtagcatcggcgggaatcacggatcggtgagagacgatcgcggaggacttgcgcaaaccaaatttggtgaattcccccccgatcttcgcgatcttgctccacatcgaaatggggttcagaggaagactttgctatccttaagggatgaggaacatagcgcgaggattcccgcggcggaaggaagtggctgagcttattgaggaggggggggcagccaacgaaggggccttttcctagttaaaaagaaaacccaaaagggtttcgtatggtgtcaaaaagccttgtggggcggctcgccttgtagtaaacagggcccgggaaaagtccacccctttgggcaaggtaggcggctctcccgaggggacgcttctttgg

SEQ ID NO: 40392 - DNA, 713 bp, Zea mays
  misc_feature: Ceres CLONE 1432992-F
  misc_feature: Encodes the peptide sequence at SEQ ID NO. 40393
aagctggagctccccgcggtggcggccgctctatactagtggatcccccgggctgcaggaattcgcacgagaccattacctagaacatcctaatcgaaaaagcgtatcttctcgagcggcggacgacgatggcagtcagaatcatcgggcatgatggacggagcctacttcgttgggcgcaaccagatccgcgggtggatcaacactacgctgcagctcggcctctccaaggtggaggaggcggcgtcaggcgcggttgcctgccaactgatggactcggagcatccagtccccgtgcaaaagcttaatgtatatttcgacgccaagacgaattaccacatgatacacaactactaggtcatgaaggatgtgttcagcaacgcactagatcactatgcatatagaggtgaacaatctcatcaaaagaaagccccttgacaatctggagttcatgcagtgcatgaaacgatattgtgattctgtcagtgccgtcttcatgaacagctacaatgcttctgacagaagggaaagcatctaagggggaaaggagacgaacagaagggcatcggtgtcctctcagacaccggccaagtctgcatccacaggacacaaggctcaagcatcacatggtgaccagcgtgcaagcatgcatacggcgggtgcaccacagcgcagcgctaagccatgacatgcagccaactctggcggacagg

SEQ ID NO: 40393 - protein, 68 aa, Zea mays
  misc_feature: Ceres CLONE 1432992-F
MMDGAYFVGRNQIRGWINTTLQLGLSKVEEAASGAVACQLMDSEHPVPVQKLNVYFDAKTNYHMIHNY

SEQ ID NO: 40394 - DNA, 879 bp, Zea mays
  misc_feature: Ceres CLONE 1432993-F
  misc_feature: Encodes the peptide sequence at SEQ ID NO. 40395
  misc_feature (14)..(14): n is a, c, t, g, unknown, or other
  misc_feature (15)..(15): n is a, c, t, g, unknown, or other
  misc_feature (21)..(21): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
ccctttctttctcnnacgccngcgaannnccccccctnnctcncaaaactggagctccccgcggtggcggccgctcttcattctctggatcccccgggactgccgagttctttcaagaattctacctcgaacctgctaatgcaaaaacgggacgtcgtctcctggacgtctaccatctcgcgcgcggcgcgacaggatgacctgcatgcggcggcagcatctctctgcgctatggtctcctcccccgccgcgcccgcccccaacgacgtcacgctacttaccgttctctccgcctgcaccgactccccatcctcgccgctagccagccccctcgccctcaccctccacgcccgcacgctcaagctattcccctcccacctcctcctctccacctgcctcgcgcggttctacctcgcggcccggcctcccgcatctggggcttccaccctgttcgactcaatggccggaccccccccggtggtttcttataaacaggttggatcgccagggcttaatgcccaaccggccgtcgttcaaaccccccttttacaatggtggttccaaagggggatggccccggccccccggaacaaaggactttcttgggaccgggcccctcatttccgacggggtttcgctccgaataaacgggtcctccccccgaaccaaggaccctctggagcggggttcccgggcgcccttgcttgttctggaaagggcgtttcaaaaacgggaatataccgcccctgttgggttcccccgaacctgggccttcgcgttggcccgtaaaggttaggggccttgttcgtgggtttcgggggagggggggggggcccccggctttctcgggtttccaagaaaggaggcattggagaccac

SEQ ID NO: 40395 - protein, 262 aa, Zea mays
  misc_feature: Ceres CLONE 1432993-F
  misc_feature (5)..(5): Xaa is any aa, unknown, or other
  misc_feature (9)..(9): Xaa is any aa, unknown, or other
  misc_feature (10)..(10): Xaa is any aa, unknown, or other
  misc_feature (13)..(13): Xaa is any aa, unknown, or other
  misc_feature (15)..(15): Xaa is any aa, unknown, or other
PFLSXTPAXXPPXLXKLELPAVAAALHSLDPPGLPSSFKNSTSNLLMQKRDVVSWTSTISRAARQDDLHAAAASLCAMVSSPAAPAPNDVTLLTVLSACTDSPSSPLASPLALTLHARTLKLFPSHLLLSTCLARFYLAARPPASGASTLFDSMAGPPPVVSYKQVGSPGLNAQPAVVQTPLLQWWFQRGMAPAPRNKGLSWDRAPHFRRGFAPNKRVLPPNQGPSGAGFPGALACSGKGVSKTGIYRPCWVPPNLGLRVGP

SEQ ID NO: 40396 - DNA, 719 bp, Zea mays
  misc_feature: Ceres CLONE 1432996-F
  misc_feature: Encodes the peptide sequence at SEQ ID NO. 40397
  misc_feature (34)..(34): n is a, c, t, g, unknown, or other
aagctggagctccccgcggtggcggccgctctgntctactgtcatgccccgggatgcaggattatctccacatccttgcctgaggcggcctactctgaaacgtttctgtctctcaccttcttcctttcctagcgattagtcacttctgctaaacccccggaccccgactagttctcaccccgagagtgactgaccgacctaccggcttgtacatgaagctgaccatctggagggtgcccaccgtcttctccaactaccaggaggacgccgacaagccgctcgcgagctgcgagaagaactgcatcggtgactgctgtctgcctgcttccaagcttctcctctacgcgttcaagttgagtccggcaaagggctcgaaggaggatgctgcttcaaccaagtgacttgttgatatcctccttactgagtgggaggacaggatgactcgaggcttattccgctacgatgtcactgcctgtgaaacaacgtcattcctggcaaccttgcgtttgttgcaacactcaatgaaaggtgccaccattagaacacgccctactgagtttcatgtgggacggtgtgatcccgtccgtctgaccctagcgaagttcaatttggccagaagtgggccaggaacaggttcatcttcccattttaggataatggcgggtcattacccttatttcctgaaagacgctcccatcctttgctgtttaacggggctc

SEQ ID NO: 40397 - protein, 62 aa, Zea mays
  misc_feature: Ceres CLONE 1432996-F
MKLTIWRVPTVFSNYQEDADKPLASCEKNCIGDCCLPASKLLLYAFKLSPAKGSKEDAASTK

SEQ ID NO: 40398 - DNA, 684 bp, Zea mays
  misc_feature: Ceres CLONE 1432997-F
  misc_feature: Encodes the peptide sequence at SEQ ID NO. 40399
agctccccgcggtggcggccgctctagaactagtggatcccccgggctgcaggaattcgcacgagaccattacctagaacatcctaatcgaaaagtctcttggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattggttgtgtctagtctatgatgttaattctatgaaatcatttgacaacctgataactgggcgagagaggttctaaattcggctaggccatcagaaccggaaaaatttccctttttgttctggtggggaaacaaatttgaagtaaattgggggcaaccgccccgggggtttcctaaaaaaaaggcaaaggggtgggggggttttccaaggggaaacccccctcacttttaaaaccttttcttaaggaagga

SEQ ID NO: 40399 - protein, 106 aa, Zea mays
  misc_feature: Ceres CLONE 1432997-F
  misc_feature (10)..(107): Pfam Name: Ras Pfam Description: Ras family
  misc_feature: SWISSPROT Homolog: EC 2.7.11.1 Non-specific serine/threonine protein kinase
MASRRRTLLKVIILGDSGVGKTSLMNQYVNKKFSNQYKATIGADFLTKEVQFEDRLFTLQIWDTAGQERFQSLGVAFYRGADWLCLVYDVNSMKSFDNLITGRERF

SEQ ID NO: 40400 - DNA, 658 bp, Zea mays
  misc_feature: Ceres CLONE 1432998-F
  misc_feature: Encodes the peptide sequence at SEQ ID NO. 40401
ggagctccccgcggtggcggccgctctagaactagtggatcccccgggctgcaggaattcgcacgagaccattacctagaacatcctaatcgaaaaaactacggccaccagtcttctcccactcccagtgccagccgccttgcgcttgccctctctgcgacgactgggtgcgccgccgccgccgctgtcctacgtcaggtgtcgaagccttcgccggcgaagagcgctcaccagattatccatctactagattcacccctggtggaggaggagaagaaggtaagcgaagatgctacggcggaacatacgtcagcgtcgggagtacctgtactccaagagcctcgagggcccccagcgggcgctgttcaagaagagcgccggatccgggcggcgctcgaggagggcagcccatccccaccgagctccgcaacgaggagcacgacctgcggaggcagatcgaccctcgagaccaggagcgtcaagttcccaggaacattcgtgaccacgagtaccctactggccaccatttcggagccccagatactattgaaccacttcccgaaatcttagcccggccctaacttaattttgttaaggaacctcaagtttgtcttcccaaactcccaaaaaaagaacccgggggggaacgggcaaatta

SEQ ID NO: 40401 - protein, 189 aa, Zea mays
  misc_feature: Ceres CLONE 1432998-F
GAPRGGGRSRTSGSPGLQEFARDHYLEHPNRKNYGHQSSPTPSASRLALALSATTGCAAAAAVLRQVSKPSPAKSAHQIIHLLDSPLVEEEKKVSEDATAEHTSASGVPVLQEPRGPPAGAVQEERRIRAALEEGSPSPPSSATRSTTCGGRSTLETRSVKFPGTFVTTSTLLATISEPQILLNHFPKS

SEQ ID NO: 40402 - DNA, 712 bp, Zea mays
  misc_feature: Ceres CLONE 1433001-F
ggagctccccgcggtggcggccgctctagaattagtggatcccccgggctgcaggaattctcacgagaccattacctagaacatcctaatcgaaaaagaaattcgtaactagagaaccgtaactccggtttgatccattcgaattgcgttggattcataataatatcgtctgtacagtatgacactaacatatatcacaccccatacttttattattagaaatttgtctagcctatgtttaatagattaacccctctaattgaagttaacctctccataattatagtttgattaaaatatgatttctagttaagttataattaagattaaagttgaattaattattaatggaatattctctcatatggtgcatactaatcaatttataatatagtttaatcacatagatcttccataaatcataactccttaaccatgactccgatcttactagttctcgaacccacgatctcgtagcgacgagtagatcattattatgcaatttgttcttatgtttggtgtgatgttaattattcctataccatgtttgtttgtattgctatgactagtagtgaggtcacgagaatctaaagatcatcttgatacctggaatctcaagtcccaagaaagttatcgcccttgatcacttttatttacccaataatgttctttataatcatttactcctgcatagggtttatttttgatggga

SEQ ID NO: 40403 - DNA, 795 bp, Zea mays
  misc_feature: Ceres CLONE 1433002-F
  misc_feature: Encodes the peptide sequence at SEQ ID NO. 40404
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tactacatcactctccctcttttttnnnaaaannnnnnncctccnnnnnacaaactggagctccccgcggtggcggccgctctagaactagtggatcccccgggctgcaggaattctcacgagaccattacctagaacatcctaatcgaaaaaaatctgccaatttgtccgaggcccatctccataaaaccctaatccacggccgcggcatccagccctgcgcccccgcccgcttgctcgcctccacccgcggtcgcggcctccagtgcccagcgccaccgccgcttgtcggcctccacctttgagcctgttcctgagtcaagtgtctctcgtggccacaggacggctacatcgacctctacgggccctacgataaggttcttctcaactgctcagggggcagcgtgtgcgggacctgcatcgtctaggtggttgaaggcaaggaaatgttgtccccgaaaactaatgtggaaaaggagttgctcaaaaggaaacccaagacgtggagattggcgtgccaggcaacggtgggcaacgcatattcgactggacaaatgatcattcaacagttgccgaagtggaagatacacgagtggggacaagctaggggttactgcttttactggtctttcaaagagtgcttctcgggggcccatactatacgattaactggccccggggaaaatggggaataaaaagaattaaggatgcttgctgaatcaggtggaaaagagcttgggtgccaaaatttgaattggaatagaaacgctttttccatacctcccaaaccaaaag

SEQ ID NO: 40404 - protein, 82 aa, Zea mays
  misc_feature: Ceres CLONE 1433002-F
MLSPKTNVEKELLKRKPKTWRLACQATVGNAYSTGQMIIQQLPKWKIHEWGQARGYCFYWSFKECFSGAHTIRLTGPGENGE

SEQ ID NO: 40405 - DNA, 727 bp, Zea mays
  misc_feature: Ceres CLONE 1433003-F
aagctggagctccccgcggtggcggccgctctagaactagtggatcccccgggctgcaggaattcgcacgagaccattacctagaacattctaatcgaaaattctcgtatcgtctcgcctgccctggccatttcggtctcctctgtatgcgcctcctccgtcgatttgcgattcacagcagcaggccggccgccaaggggagcaatcattacccagtggcccaaccgaagatacgcttgagtctgcaggcctcccacccgcctcgatcgatgcgaggcacaatgccggccaccgactcctcctcctcctcctcctcgtcgccggcggcggctccactgtcctccatcggacgctccatccgctcgctccgcagggaccagaaccagatccactctcttcccgccgccgccagacgccacagagcccttccagcgccgcgccgccgaagtcctggccgacctcccggcagccgactgagacgtctccctcgcctggacgcgcgtgctcctcgaatccttccacctctgcctcgaggagttcagcgccctgctcttcggctccggggactcgcccgatgctcggccgccgctcgaccgcctcgtcgccaacttctccgagcgcgcgcgtaaggggctcgacctctagcacgccgatccgcgactgcctctatctcgtccgccagaggacgctaggacatcgtcatcagggcagtcgatctcgactcgtc

SEQ ID NO: 40406 - DNA, 719 bp, Zea mays
  misc_feature: Ceres CLONE 1433008-F
  misc_feature: Encodes the peptide sequence at SEQ ID NO. 40407
  misc_feature (487)..(487): n is a, c, t, g, unknown, or other
  misc_feature (701)..(701): n is a, c, t, g, unknown, or other
aagctggagctccccgcggtggcggccgctctagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacggaggagattccacctccctaaacctgaaccagctctggaagaggtttaggggggaagaacagccaccggcacatctaggtgcaagcagagattacnatgtagacatggttccaaagtttatgatggcaaacggggacttggttcgcactctcattcacactgatgtgacaaatatttgtcattccaagctgtgatggaagctatgtcttcagcaaacggagaatcacaaggttcctgcccacgatatggaggctctaaaatctcctttgatgggtctatttgagaacgtagagcagggacttttttgttnacgtcaaaattaccatgg

SEQ ID NO: 40407 - protein, 103 aa, Zea mays
  misc_feature: Ceres CLONE 1433008-F
  misc_feature (1)..(104): Pfam Name: GDI Pfam Description: GDP dissociation inhibitor
  misc_feature (72)..(72): Xaa is any aa, unknown, or other
MDEEYDVIVLGTGLKECILSGLLSVDGLKVLHMDRNDYYGGDSTSLNLNQLWKRFRGEEQPPAHLGASRDYXVDMVPKFMMANGDLVRTLIHTDVTNICHSKL

SEQ ID NO: 40408 - DNA, 708 bp, Zea mays
  misc_feature: Ceres CLONE 1433010-F
  misc_feature: Encodes the peptide sequence at SEQ ID NO. 40409
ctagatttagtggatcccccgggctgcaggaatttgcacgagaccattacctagaacatcctaatcgaaaacaagagaaggcacctaccagccgccactcgccgaaatgaggaacacgactggcgacgggatgcagaggcagcgcgcccctctatgcccgacgccaccgagccctgcggctgcagataaacctgtgccaatggccaaacaaaaagagggggtggacaaaagaactgctaggaagatgatccgatctacggaaggctgtgcaaagagcattactttcgagaggaacaacaaatcacacgcggagcagcttcacgatctgccgaatgacatcgtaggtagcatactatcagggtggacattcagagaatcctcacagatggaccttgtttctcataactggcggcggctgtggagaagctgttgccggaaactggtcttccccagtgccaccatgttccaacccggaaatcggagcatcaaacatacggggaccaactttgccatgagagtcaacagtttcttgcgtcagatacaacctcatactactcttaataagtctgtgattaacttcgggctggggcaggaagcccactcgcctggatcaaggatgaattcgacttctggtccctggtcacgagcaaggaaacatcagttaattagtttcgcctcctggaagtgaaaacgataatgtcatggggt

SEQ ID NO: 40409 - protein, 193 aa, Zea mays
  misc_feature: Ceres CLONE 1433010-F
MRNTTGDGMQRQRAPLCPTPPSPAAADKPVPMAKQKEGVDKRTARKMIRSTEGCAKSITFERNNKSHAEQLHDLPNDIVGSILSGWTFRESSQMDLVSHNWRRLWRSCCRKLVFPSATMFQPGNRSIKHTGTNFAMRVNSFLRQIQPHTTLNKSVINFGLGQEAHSPGSRMNSTSGPWSRARKHQLISFASWK

SEQ ID NO: 40410 - DNA, 703 bp, Zea mays
  misc_feature: Ceres CLONE 1433013-F
  misc_feature: Encodes the peptide sequence at SEQ ID NO. 40411
aagctggagctccccgcggtggcggccgctctagatctagtggatcccccgggctgcaggaattctcacgagaccattacctagaacatcctaatcgaaaaatcaatcgtcaatgcaagtttgtccattcgcattggtctgaatactgtagctactaccgcgagtgccactgtgccgcagctgcctgctcgccattactgcaagctgtgttcaatcaaagcttaattacgctccctctacatctgatccagctaagtagctagccagcactacagaagggcgtggcatgaatcaggatagagatagcaggggggctagctagctgagctcgtgcgacgaagaatggccggaattggcaggaacatggtggcgccgctcctggtgctcaacctcatcatgtacatcatcgtcatcagcttcgcgagctggaacctgaaccacttcatcaacaggaataccaactaccccggcgtggccggcaacggcgcgacgttctacttcatggtgttcgccatcctggccggagtggtgcgcgcgacttccaaactggcgggcgtgcaccacgtgcgcgcctgacgccacgacagcctggacaccaacgccgcgtcatcgctcatcgcctgggccatcacgggcgctcgccttcgggctggcctgcaaagagatccacatcgacggacaccgcggctggcccctgcccgtg

SEQ ID NO: 40411 - protein, 77 aa, Zea mays
  misc_feature: Ceres CLONE 1433013-F
  misc_feature (14)..(78): Pfam Name: AWPM-19 Pfam Description: AWPM-19-like family
MAGIGRNMVAPLLVLNLIMYIIVISFASWNLNHFINRNTNYPGVAGNGATFYFMVFAILAGVVRATSKLAGVHHVRA

SEQ ID NO: 40412 - DNA, 441 bp, Zea mays
  misc_feature: Ceres CLONE 1433014-F
  misc_feature: Encodes the peptide sequence at SEQ ID NO. 40413
aagctggactccccgcggtgggcggccgctctagaactagtggatcccccgggctgcaggaattcgcacgagaccttacctagaacatcctaatcgaaactcggctcatctcatttttctatttcggccctctactgttccaataataataaaaagattctcgattcgattcactcgcattttcagtgagcgggcggcgatcggcttcgatcgcgcaccgcggcggaacggaaatgtttccctggccggtggaaagccctgatcccgggtgggaaccccttgccgggggaaaaggaaacggaaaggcggaactttcgaaggggggccccaaggggggggaaggggaaacccggaaaagggagggttgggggatttttaaaacccctttgggaaaccgggggaactttttttttaaagggaaaccccccgggggagaaaatc

SEQ ID NO: 40413 - protein, 30 aa, Zea mays
  misc_feature: Ceres CLONE 1433014-F
KLDSPRWAAALELVDPPGCRNSHETLPRTS

SEQ ID NO: 40414 - DNA, 705 bp, Zea mays
  misc_feature: Ceres CLONE 1433015-F
  misc_feature: Encodes the peptide sequence at SEQ ID NO. 40415
aagctggagctccccgcggtggcggccgctctagaactagtggatcccccgggctgcaggaattcgcacgagaccattacctagaacatcctaatcgaaaaattccattccacacaaggctaggcacaagcgaaccaaacccatggcgtccgacggccgcggcgtggtgacggtgtacggcatcaacggcgcggagctgctggagccgtccaagcagcccaagtcggcgactttctccgtcagggtggggctggcgcagatgctccggggcggggtcatcatggacgtgatgaccccggatcaggcgcgcctcgcggaggaggccggcgcgtgcgccgtgatggcgctggagcgggtccccgcctacatccgcgcgcagggcggcgtggcgcgcatgtcagacccgggcctcatccgcgacatcaagcgcgccgtcaccatcccggtcatggccaatgcccgcatcgggcacttcgtggaggcccagatcctggaggccgtgggcgtccactacatggactacagcgaggtgctgacccccgccgacgacccgcaccacatcaacaagcacaacttccgcgtccccttcgtctgcggctgccgcgacctcggcgaggcgctccgcagggtgcgcgagggcgccgccatgatccgcaccaaggatgaggccggcacgggcaacgtcttcaaggccgtgcgccacgt

SEQ ID NO: 40415 - protein, 187 aa, Zea mays
  misc_feature: Ceres CLONE 1433015-F
  misc_feature (29)..(187): Pfam Name: SOR_SNZ Pfam Description: SOR/SNZ family
MASDGRGVVTVYGINGAELLEPSKQPKSATFSVRVGLAQMLRGGVIMDVMTPDQARLAEEAGACAVMALERVPAYIRAQGGVARMSDPGLIRDIKRAVTIPVMANARIGHFVEAQILEAVGVHYMDYSEVLTPADDPHHINKHNFRVPFVCGCRDLGEALRRVREGAAMIRTKDEAGTGNVFKAVRH

SEQ ID NO: 40416 - DNA, 672 bp, Zea mays
  misc_feature: Ceres CLONE 1433016-F
  misc_feature: Encodes the peptide sequence at SEQ ID NO. 40417
aaagctggagctccccgcggtggcggccgctcatacacagcggatcccccgggctgcaggttatcgcacgagaccattacctagaacatcctaatcgaaaactccttcgttctgtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagggttttattatgcatttcctcagatgcaaccaaatgaatttcgttatgattttaggcacatgctattttgctgtgtggtttgctgggtcgatgcataagcggccctactgttcaccagatagggctgataaagctaattactcctacaataatgatggagagaagagcaatgttccttcattaaagaaccttcctccaattgttcatcatgaaacattcttcagcaatgttcagaatgactacaatcaaacaggattagtgccctttggagggatgttctgccagtgaggcttcacagcttctcagtgatcgctggactgctgcaatcaacatgtacaatgaccaaacaattgacccctcagaagaaccggtaatgtattctggatctac

SEQ ID NO: 40417 - protein, 84 aa, Zea mays
  misc_feature: Ceres CLONE 1433016-F
MNFVMILGTCYFAVWFAGSMHKRPYCSPDRADKANYSYNNDGEKSNVPSLKNLPPIVHHETFFSNVQNDYNQTGLVPFGGMFCQ

SEQ ID NO: 40418 - DNA, 676 bp, Zea mays
  misc_feature: Ceres CLONE 1433017-F
ggagctccccgcggtggcggccgctctagaactagtggatcccccgggctgcaggaattcgcacgagaccattacctagaacatcctaatcgaaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgggtacatgtgacgatgcacttaaacttctctgcagtgctttcggatgtcaaatagaagagataacattaccagagcttgaagagatgcgtactgctcatgttgtctcaattggctcagaatcattctgtgacttgaatcctcattacaaagcaggaagaaaaactgagtttaccttggatactcgaacaagtttggcactttttgggtctttcactgcaactgattatgtggcttctcaaagtataaggaggaggataatgcattatcacatggaagctttcaagaaggtcaatgtcatagcaactcctacaactggcattactgctccaaaaatacctccaagtgctctgaagtcaggagagtcagattatgttgtgtcagct

SEQ ID NO: 40419 - DNA, 713 bp, Zea mays
  misc_feature: Ceres CLONE 1433025-F
  misc_feature: Encodes the peptide sequence at SEQ ID NO. 40420
  misc_feature (713)..(713): n is a, c, t, g, unknown, or other
ggagctccccgcggtggcggccgctctataactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattcggaaaacttcacggtcgagaactctgttctgttcgctggtccgttn

SEQ ID NO: 40420 - protein, 159 aa, Zea mays; identical to SEQ ID NO: 36910
  misc_feature: Ceres CLONE 1433025-F
  misc_feature (58)..(160): Pfam Name: PAP_fibrillin Pfam Description: PAP_fibrillin

SEQ ID NO: 40421 - DNA, 692 bp, Zea mays
  misc_feature: Ceres CLONE 1433026-F
  misc_feature: Encodes the peptide sequence at SEQ ID NO. 40422
aagctggagctccccgcggtggcggccgctctataactagtggatcccccgggctgcaggaattcgcacgagaccattacctagaacatcctaatcgaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggagggacctcatcaccaccaccgcctggttccgcgaccactggtcccgcgagcacgcccacctggacgagatagcccagcagctcgagttggtcgccctccttgcctaccatgaggatgaggacctcttctacggcgagcaagcccccgccgccgccgcccttaagacagattcggtgctcaaggcactgaacttgggttccccgaagagcgacgacgccccgcggcggttacagtagaacccacgcactccgagaagccgaccaagtacgccggcagccccaa

SEQ ID NO: 40422 - protein, 110 aa, Zea mays
  misc_feature: Ceres CLONE 1433026-F
MSAVAVSSSLNPNAPLFIPAALLQVEDFSPQWRDLITTTAWFRDHWSREHAHLDEIAQQLELVALLAYHEDEDLFYGEQAPAAAALKTDSVLKALNLGSPKSDDAPRRLQ

SEQ ID NO: 40423 - DNA, 859 bp, Zea mays
  misc_feature: Ceres CLONE 1433029-F
  misc_feature: Translation starting site: 229
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
ggttgttggggtttttttttttttaagnnnncnnnnnnnnnnnnaaaagctggagctccccgcggtggcggccgctctagaactagtggatcccccgggctgcaggaattcgcacgagaccattacctagaacatcctaatcaaaaatagtccctcagattcttaccaaaacacaggagcccgtcggacgtcggaaaaaagcaaaacaagatcaccgtatcatggtaaatggtgacgcttcccgcttcgacggccgcctcgccgctgcagcgacgccggctgctccccggggggcagcgcgcgacgtacgtccgggccacggcctacgtcggcgagccgtacctctccgtgcgcgtgaacgggctgcagatgcccaacccgttcgtggatgggggtcggggcaaccgggcgccaactacagtggcatgcaccgcgcgtacgacgaggattggggtgccgacatccccccccctgcgtcattggaagcccagaaaagaaatcacggctacctcctccataatcccgaggcttgggggccacgaaacaaaaagggagcgtgccaaggggcgcgccgtccatttggttgggcacaaccccttggaattgatggaggggggcaaggcacttcctgggggggccattgttcgacatgactctcaaagcccgtttggaagaagggcggggaccccgggagggggaaaagacttccgcccgtccccctcctaggggcgggagtacctaccacacaactctgcggggaagcgaggcgctccctggacgagcccgcgcgtgcagaaagctgggggaaaattgcaagcgacgcacgggaagagggacacgtctgcggcggcagcggacg

SEQ ID NO: 40424 - DNA, 772 bp, Zea mays
  misc_feature: Ceres CLONE 1433035-F
  misc_feature: Encodes the peptide sequence at SEQ ID NO. 40425
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (35)..(35): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttgccccgcccgttgggggnnnttcaggcgggggnctttttttcannnnnnaaaaaatggagctccccgcggtggcggccgctctagaatagtggatcccccgggctgcaggaattcgcacgagaccattacctagaacatcctaatcgaaaagcagatcagatcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaagggcaccggcggcgagtccatccacggcgagaagttccccgacaagaagttccggcgcaagcaccccgcccccgggtgggctctccagggccaacgcccgggcccaaaaccaaggggttcccagttctttctttggaccgtcggggaccccttgggctcgacgggagagacgggtcttctttcggccaagtccctccaaggggcatggaacctctcccaagggcccatgaagaaagggtggggaaacccggaaaggggttcccccttcccaagggggggtcaaagggccccttgaagtggggggacaacctcttccttaatat

SEQ ID NO: 40425 - protein, 175 aa, Zea mays
  misc_feature: Ceres CLONE 1433035-F
  misc_feature (5)..(161): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLHYKGSTFHRVIPEFMCQGGDFTRGKGTGGESIHGEKFPDKKFRRKHPAPGWALQGQRPGPKPRGSQFFLWTVGDPLGSTGETGLLSAKSLQGAWNLSQGPMKKGWGNPERGSPFPRGGQRAP

SEQ ID NO: 40426 - DNA, 819 bp, Zea mays
  misc_feature: Ceres CLONE 1433037-F
  misc_feature: Encodes the peptide sequence at SEQ ID NO. 40427
  misc_feature (7)..(7): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ttttttntttttttttttttatgttccccccannnnnnnnnnnnnnaaaagctggagctccccgcggtggcggccgctctagattagtggatcccccgggctgcaggaattctcacgagaccattacctagaacatcctaatcgaaaaacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcaaatgctccggggcggggtcatcatggacgtggtgaccccggagcaggcgcgcctcgcggaggaggccggcgcgtgcgccgtgatggcgctggagcgggtccccgccgacatccgcgcgcagggcggtttggcgcgcatgtcggacccggccctcatccgcgacatcaaggcgcgcctcccccatcccggtcatggcccaaggcccgccatcgggaacttcgtggagggcccaaatcctggaaggccgggggcctccaactacgtgggacaaaagccaaggtgctgacccccgcccaacgaacccgcaccaccttcaacaagccccaactttccgcggccccctttccgtcggcgggttggccgccaaccttcggggaagggcgcttcctccaggggggggcgccaaggggcccccctccttggattcccccaaccaagggggggaagggcccggtcaccgggcccaacctcccctcccaaggcccggggcgcgccccgggtggcccctctcccgtacatgggggcg

SEQ ID NO: 40427 - protein, 133 aa, Zea mays
  misc_feature: Ceres CLONE 1433037-F
MASDGSGVVTVYGSNGAELLEPSKQPKSATFSVKVGLAQMLRGGVIMDVVTPEQARLAEEAGACAVMALERVPADIRAQGGLARMSDPALIRDIKARLPHPGHGPRPAIGNFVEGPNPGRPGASNYVGQKPRC

SEQ ID NO: 40428 - DNA, 662 bp, Zea mays
  misc_feature: Ceres CLONE 1433039-F
  misc_feature: Encodes the peptide sequence at SEQ ID NO. 40429
tcttaactagtggatcccccgggctgcaggatttcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagggagactggtgctgggaagcacgtgccccgtgctgtcctccttgacctttgacccactgtttttcgatgaggccgagaatgggaccaaacccgcggattcttccaccctgagcagctcatcaggggggagggaggaatgcacccaacaactttggcccgtggtccataaacccattgggaaggaaaattgctgacccaatgccttggttcggttccaggaagctgggcgaaaaattggggggggttccaggggtttcctcggtcttcaaaccctgatggcgaagagaacgcggccccgggcctagggtttcctcc

SEQ ID NO: 40429 - protein, 70 aa, Zea mays
  misc_feature: Ceres CLONE 1433039-F
MRECISIHIGQAGIQVGNACWELYCLEHGIQADGQMPGDKTIGGGDDAFNTFFRETGAGKHVPRAVLLDL

SEQ ID NO: 40430 - DNA, 833 bp, Zea mays
  misc_feature: Ceres CLONE 1433042-F
  misc_feature (833)..(833): n is a, c, t, g, unknown, or other
gggtgggggccggtgtttcggtggggccggggggagatcctccgccccccccccccgggggctcactgtggggggggcggctcttttgtagtggatcccccgggctgcaggattcgcacgagaccattacctagaacatcctaatcgaaaagttgttggttggattccattggagccgtcgcacctcagggagctgaggaatacgtttccgtcgggagctgatcgagaaacggaggggtggttccggtttcagtccggctagctagctagttagaagacggcatgcgctgacggaggggttcctccctccgaggagatgatgaggtcgcgtctgtacgagtggtgagcccatgttctgccgaaagtgcgagagaaatgggctgggggcggcttgtatccacagcgtcctcccgaccccgccatgtgctcttggggggtaacagcgggatcgtcctaggatctgggtcatgaaggcggcccccccatcgactaccacctggtttccgtggggggccacgcgcgtctttcgaagcgggccatagattccgggaagggggccccggggaacgaggccggggacgctgccagcttgtaaccccgctcccccccccgttcggaccaccgacaagccggcgcgtgagtgaacccgggcccgcttttccccggccccaaggggcacctggggttacgccggccccgcgaatcccacaatgggacccggcgggacctccgggggctggccgccccgtgaggtctccccattcccctgttaagtgggggtgtcgaaccttccggggggcccccgcgcgccaactggccccgggctgagtagn

SEQ ID NO: 40431 - DNA, 719 bp, Zea mays
  misc_feature: Ceres CLONE 1433045-F
  misc_feature: Encodes the peptide sequence at SEQ ID NO. 40432
  misc_feature (403)..(403): n is a, c, t, g, unknown, or other
  misc_feature (416)..(416): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcaaacgggaccgcaaggaggacctgcggtggtgcaagcaggcgtgcgagtggcagtacggaaaggacaccccggggaagagggaatgcnagagcgagtgccnccagcggcaccagcaagctgacgcgggcgaggacggcgacagcggcgtggacgcctacgtctcccgctccgggaggggcgagtgccggcgccagtgcctgcgccgccacgagggccagccgtgggaaacccaggaatgcatgaggcggtgccccccgccccggactggccgtcgacatggagcaagagtacggtcgcggcagcgagagccgcgggcaagtggccgggagaggtgcaagcgccccccccgccgggactggtggggaaaggcacctcttccttgaggaatggaagaaccccggga

SEQ ID NO: 40432 - protein, 161 aa, Zea mays
  misc_feature: Ceres CLONE 1433045-F
  misc_feature (64)..(64): Xaa is any aa, unknown, or other
  misc_feature (68)..(68): Xaa is any aa, unknown, or other
MGKGSVGASWWAFLLLAGVLLVVAATAGAEDGVVKRDRKEDLRWCKQACEWQYGKDTPGKRECXSECXQRHQQADAGEDGDSGVDAYVSRSGRGECRRQCLRRHEGQPWETQECMRRCPPPRTGRRHGARVRSRQREPRASGRERCKRPPRRDWWGKAPLP

SEQ ID NO: 40433 - DNA, 836 bp, Zea mays
  misc_feature: Ceres CLONE 1433046-F
  misc_feature: Encodes the peptide sequence at SEQ ID NO. 40434
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
gcgccggggcgccgctttctttgggcccccncccccnnnnnnnnnntttggagctccaccgcggtggcggccgctctagaactagtggatcccccgggctgcaggaattcgcacgagaccattacctagaacatcctaatcgaaaaaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttttcccccccctgaccggcatgactatcaccctcgagggtggagccctctgacaccattgacaacgtcaagggcccaaaatccagggacaagggggggatcccctccagaaccagcaccggcctcattcttttgctggggaagcagctttgaaggacagggcgccacgccttgcccaactacgaacattccggaaaggagatcccccctcccacttggggggcttgccgccttcaggggaaggccgttgcctgatctttcgtaggaaacacccctggaccggggaaaaaaactatccccccccccggaggtgggaaaactcttgtgagaagcggatagcgaagaagcggttaaagtggctcaagaataccgcgg

SEQ ID NO: 40434 - protein, 96 aa, Zea mays
  misc_feature: Ceres CLONE 1433046-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFFPPLTGMTITLEGGAL

SEQ ID NO: 40435 - DNA, 766 bp, Zea mays
  misc_feature: Ceres CLONE 1433047-F
  misc_feature: Encodes the peptide sequence at SEQ ID NO. 40436
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ggggggggcgtgtcgttttcnnnccnnncgggtacaataannnnnnnnnnnnccaagctgggactccccgcggtggcggccgctctatactagtggatcccccgggctgcaggttttcgcacgagaccattacctagaacatcctaatcgaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccaccctcggtgcatctcccaccgccgggtccacctgccgccgtcggttcaactgccaccgccggctcatgtgcccccccccggtcttctgccgccccccccatgcatttgcccaaccaaccgcccggggcctcaccctcatccccaggcaaatccttggccgtgtgcaaaagccccaatccaaccccggggccaggcggacggggacctctgcggggtttgggaccccccccatatcctggggcccaggcgatccaatgtcccgaagggatttcaggggccacccgaaggggaaaaccccctttggggcctcctccaagagtccccccctctttccggccataatatgtttttcgcccccccgcctcggcggggggggggccccccccacccgccgcg

SEQ ID NO: 40436 - protein, 162 aa, Zea mays
  misc_feature: Ceres CLONE 1433047-F
MRVLLVALALLALAASATSTHTSGGCGCQPPPPVHLPPPVHLPPPVHLPPSVHLPPPGPPAAVGSTATAGSCAPPRSSAAPPMHLPNQPPGASPSSPGKSLAVCKSPNPTPGPGGRGPLRGLGPPPYPGAQAIQCPEGISGATRRGKPPLGPPPRVPPSFRP

SEQ ID NO: 40437 - DNA, 909 bp, Zea mays
  misc_feature: Ceres CLONE 1433048-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (15)..(15): n is a, c, t, g, unknown, or other
  misc_feature (18)..(18): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
nnnnggggttttaanttnaaggtggggtttttttttccannncntaaagtgggactccaccgcggtggcggccgctctagatctagtggatcccccgggctgcaggagttttcccgagaccattacctagaacatcctaatcgaaaaactaaactattgcggggtattaagctctctccctccgcgcttctgaacagttctcgacgactccaggaggggcgcacttgactttcccctcctcctaccggcgagcaccttcctcgcctcgctgttatggcctcatctgatcctattcagcgccatgttgtggcgctgagggtgcccatttcactgccaaggatgccagacgagggtgaaaatcgtgctccagaacatctttcggggtggtaccgttgccgaaaatcggttgcccggagcaatcgtggtcttgggccccctgtcctcgtacgggaacttgatccctctccgtttgcttgttaacccacccgcggcggttcttccagccaaacaacgttgaaaactcacccgcccgggaaccaccagtggatgcgcttcgggtgccgggccaagatcgggggatctctctctgcttttagactctccaaagtgcgggtggggggaggccgataataccccaaactaatcccctggtgagagggccggggtgcagaagtcgaatgggggaacattggccttatggaaatgcgggggctttcttgactccataatgtacgtgtggaagacgctcgcccctctttcggttaatcgatgatctgatgcgtcccagcccttttggtggtcgtgttcgtcctatagtgccaattttcggagcgcgtgagaagggtcctccactaattagccgccgtcccccaaaggactgtagaaaagtaactaacaaggccgcgccaa

SEQ ID NO: 40438 - DNA, 970 bp, Zea mays
  misc_feature: Ceres CLONE 1433053-F
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
ggggggggggtttttttttttctcggccccccnnnnggcgaaanaaaaaactggagctccccgcggtggcggccgctctagtttagtggatcccccgggctgcaggaattttcacgagaccattacctagaacatcataatcgaaaaatcgatcgtcaatgcaagtttgtccattcgcattggtctgaatactgtacctactagcgcgagtgccactgtgccggagctgcctgctccccattactgcgggctgtgttcaatcaaagcttaattaggctccctctacatgtgatccagctaagtacctagccagcacaacagaggggcgtggccagaactcggaagagagaataacgggggggccaaccaacctcaacctccgtccgacaaaaaaatggccggaaattggacaaggaacaagggggggacgcccgctacctcggcggcccaacccgccacctcacgtaccattccatcggtgcggtcggccgtcccacccccccctccaaaccccgtgaacaccgttctccagacacaacggggtacataaacccaactctcccccccggggggatgggtaccccgtgaaaaacgtcgacgccgccaaccgggctcgtggaattgttcccgggagggggacccgcgcccagtctccgtgaggctcagagactctggggaggtgagggattacttgctccgtgtcgcgtaagcccgagtgcgcccgccccgacgcccacccaacgcctgttcggccccctcgtctctcgtcctctcgtaagagtgagtctgtgcgcgctcgtacagttcgtccctctcctcctttcccccctatcttctcttacggtggtcgctcggtgtgcggtggtcacgataacgggatattgagggagttggaggtagagattgacggacagtcacggacgttctagacgcggtacgtccgctgcgtgttagctgcccccgtgcgccc

SEQ ID NO: 40439 - DNA, 658 bp, Zea mays
  misc_feature: Ceres CLONE 1433054-F
  misc_feature: Encodes the peptide sequence at SEQ ID NO. 40440
  misc_feature (570)..(570): n is a, c, t, g, unknown, or other
  misc_feature (571)..(571): n is a, c, t, g, unknown, or other
tggcggccgctctagaactagtggatcccccgggctgcaggaattcgcacgagaccattacctagaacatcctaatcgaaaacccctcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctccctcatcgagcagaaggagaaggccgcgggaacgaagcgcacgccgcatccatccgcgcctaccgctccaagatcgagggcgaagctcgccgcatctgcgacgggatcctcggctcctcggatcccacttgtccaatcgccggnngggccgagttccaggccttctacctaagatgaggggggactccccaaatccctgcttagatcaatccgggtccaaaagaaagaatct

SEQ ID NO: 40440 - protein, 130 aa, Zea mays
  misc_feature: Ceres CLONE 1433054-F
  misc_feature (122)..(122): Xaa is any aa, unknown, or other
MSPSEPTREESVYMAKLAEQAERYEEMVEFMERVARYAGGAGGGEELSVEERNLLSVAYKNVIGARRASWRIISLIEQKEKAAGTKRTPHPSAPTAPRSRAKLAASATGSSAPRIPLVQSPXGPSSRPST

SEQ ID NO: 40441 - DNA, 608 bp, Zea mays
  misc_feature: Ceres CLONE 1433057-F
  misc_feature (169)..(169): n is a, c, t, g, unknown, or other
  misc_feature (203)..(203): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (601)..(601): n is a, c, t, g, unknown, or other
ccgctctagaactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctttggnccaaggcccaaccaaaaggcgggccaggccgggncgnnnnnnnnnntnnnnnnnccccgggnnnnaaaaaaaccaaggggcccccccttttcccaccccccaagggggcccccggggccccccaaaattttccaaccctttttccccggggggggggccccaagggttttaaaccccccccccgggggggggcccccccggcccttggggggaaaaaaccttttgggggccccaaaaaaggggaaaaagatttttttggggggggggggggggaaaaaaaaaaattttttttgggaaaaaaaagaaaaaaaaccggggggcccctttttttgttgggcccccccctttttgtggggcgcccccttggtggggggggttttttttttgggggcgcccccccccccccccaaaaaaaaaaaaaaaccccccccnccccccc

SEQ ID NO: 40442 - DNA, 531 bp, Zea mays
  misc_feature: Ceres CLONE 1433060-F
  misc_feature (247)..(247): n is a, c, t, g, unknown, or other
  misc_feature (431)..(431): n is a, c, t, g, unknown, or other
ggagctccccgcggtggcggccgctctagaatagtggatcccccgggctgcaggaattcgcacgagaccattacctagaacatcctaatcgaaaaatcaaccatattattgagaccaacaagcaacatagaaagtggaatccagtagcaacacagagcaacaatggcgaccaagaaaatttttccctcctatgctccttgctctttctgctgtgttgctaacgcgaacaatttttccctccaatggntccacaagctcctaaagcttcccttcttccccccaaaaccttttcaataaaaaagagaagccttcccggaatggggaaaaacccccgctttttccgcccctcttaaggggctcccaaaaaaggaattccgggaaagggaaaaaaattcctttttttaccccccccttgttgggtggtttcaaanaaaaaaaacccccccgccccccctttttttttggggggggcctctttttgggaaaaaaaaaacatccgggggggaaaaaatttttttgttaaaacatttt

SEQ ID NO: 40443 - DNA, 739 bp, Zea mays
  misc_feature: Ceres CLONE 1433074-F
  misc_feature (294)..(294): n is a, c, t, g, unknown, or other
  misc_feature (295)..(295): n is a, c, t, g, unknown, or other
  misc_feature (434)..(434): n is a, c, t, g, unknown, or other
  misc_feature (480)..(480): n is a, c, t, g, unknown, or other
ctggagctccccgcggtggcggccgctctagaactagtggatcccccgggctgcaggaattcgcacgagaccattacctagaacatcctaatcgaaaaaactaggagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggcccctcgcgcnngtcgccaccctcgccagcgccggcgccgggcgcccgctcccgcgcgctccgtgctgggcacacggactcaatccttgaggtgctggcacaggacgatatgctgaacgcaaaagagctggtccatggggaagatggcttngtcatcaatgactagccgctaggcaggggatcccaatccggaaacntggccccccaatggcctcttagaaaggaaaaaaggagaggactggggaacccccttaaaactcctaaaaaaaattttttggaaaaggaatttgaattccttaaggcgtttttaaaaacccttttgggaggggtatttggggtaaaaaaaacccccccctcaaaaaattttttgggggttttaaaaaccccacaaccccaaagggggcccctcttttttttttgaaaaaaaaaaaccctccccagggggggggttgccga

SEQ ID NO: 40444 - DNA, 726 bp, Zea mays
  misc_feature: Ceres CLONE 1433082-F
  misc_feature: Encodes the peptide sequence at SEQ ID NO. 40445
  misc_feature (227)..(227): n is a, c, t, g, unknown, or other
  misc_feature (229)..(229): n is a, c, t, g, unknown, or other
  misc_feature (230)..(230): n is a, c, t, g, unknown, or other
  misc_feature (232)..(232): n is a, c, t, g, unknown, or other
aaagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagcagggtcctgcggcggcgncnncncttccggctccccttcccattggcctccacgatggcgctccgcctcaacgacgtcgcgctctgcctctccccgccgctcgccgcccgccgccgccgccgcagcagcggcaggttcgtcgctgtcgcctccatgacgtccgccgtctccaccaaggtcgagaataagaagccatttgctcctccaacgcaggtacatgtccaggttacacattcaatgccacctcacaagattgaaattttcaagtcccttgatgattgggctagagataatatcttgacccatctcaggccagtcgagaagtgttggcagccacaggatttcctcccggacccagcatctgaaggatttcatgatgaagttaaggagctcagagaaacgtgccaaggaaatccctgaagattattttgtttgttttgggggaagactgattaccaaggaagctctaccaacttccagactatgcttaacaccctcgacggggtcagaaatgaac

SEQ ID NO: 40445 - protein, 121 aa, Zea mays
  misc_feature: Ceres CLONE 1433082-F
  misc_feature: SWISSPROT Homolog: EC 1.14.19.2 Acyl-[acyl-carrier-protein] desaturase
MALRLNDVALCLSPPLAARRRRRSSGRFVAVASMTSAVSTKVENKKPFAPPTQVHVQVTHSMPPHKIEIFKSLDDWARDNILTHLRPVEKCWQPQDFLPDPASEGFHDEVKELRETCQGNP

SEQ ID NO: 40446 - DNA, 696 bp, Zea mays
  misc_feature: Ceres CLONE 1433083-F
  misc_feature: Encodes the peptide sequence at SEQ ID NO. 40447
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaacctagaacatcttaatcgaaaattatattcttctgcctgcccttccgttcaatttcaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaatatgtctgtttttgtgacgccccatcaatttgtggagggtatatgtaagaagcttgtatggaagctaacaccangagctgaggctatctccctacatcagggcatggaggtcaagaatgaagggccgtgcat

SEQ ID NO: 40447 - protein, 137 aa, Zea mays
  misc_feature: Ceres CLONE 1433083-F
  misc_feature (10)..(137): Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
  misc_feature (119)..(119): Xaa is any aa, unknown, or other
MEMENGHAKYRVAVIGSGNWGSVASRLIASNTAKLPSFYDEVRMWVFEEILPTGRKLSESINEQNENCKYLPGIKLGTNVIADPDLESAVKDANMSVFVTPHQFVEGICKKLVWKLTPXAEAISLHQGMEVKNEGPC

SEQ ID NO: 40448 - DNA, 669 bp, Zea mays
  misc_feature: Ceres CLONE 1433090-F
  misc_feature: Encodes the peptide sequence at SEQ ID NO. 40449
  misc_feature (669)..(669): n is a, c, t, g, unknown, or other
tccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactgggtggttttgaggctggtatctcccaaggagggcccgaccccggaaaattgctcccccttgggtctcccccctggaaagaaaaaaaaaaataatttttctcgccccaaaaaaaaagaggggggcgcccccacccctccaan

SEQ ID NO: 40449 - protein, 123 aa, Zea mays
  misc_feature: Ceres CLONE 1433090-F
  misc_feature (5)..(124): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGWF

SEQ ID NO: 40450 - DNA, 708 bp, Zea mays
  misc_feature: Ceres CLONE 1433091-F
  misc_feature: Encodes the peptide sequence at SEQ ID NO. 40451
aaagctggagctccccgcggtggcggccgctctagaactagtggatcccccgggctgcaggaattcgcacgagaccattacctagaacatcctaatcgaaaaaacaccaccgctcgactgctctcaccgaccagcgctgcgccactcctccgccggatctccagcatgcagccctcctcctcgtcctcctccgctcacccgcccgaccatcccaactccaagcccccggccccgccggcccccgccatgggctaccccgccaaccccgcccccaacgggaaccccagcgcctacttcgccgccgcgccgcccgccgccgccgccgccaacggctccgctccggcgtccttcggcgtcgcctacccctaccccgcccctcctcaccaccatcacccgccgccgcaccaccactacccgtaccccccgcccccgccgacgcaccaccactacgcggcccacccgccgccgccgcccacctgcctgcgccgcctcctcgccgccgtcgttggcgccttccttctcctcggcgccgccaccttcatagtctggctcctcctccgcccgcgcgccccggccttctccctcacctccctggccctctcccgcgtcgcttactcccccgccaactcctcactctccgcctccttcgacgctgccctcctcgccgccaaccccaacgccaagctctccgtcgcctacttctcaccc

SEQ ID NO: 40451 - protein, 181 aa, Zea mays
  misc_feature: Ceres CLONE 1433091-F
MQPSSSSSSAHPPDHPNSKPPAPPAPAMGYPANPAPNGNPSAYFAAAPPAAAAANGSAPASFGVAYPYPAPPHHHHPPPHHHYPYPPPPPTHHHYAAHPPPPPTCLRRLLAAVVGAFLLLGAATFIVWLLLRPRAPAFSLTSLALSRVAYSPANSSLSASFDAALLAANPNAKLSVAYFSP

SEQ ID NO: 40452 - DNA, 832 bp, Zea mays
  misc_feature: Ceres CLONE 1433093-F
  misc_feature (11)..(11): n is a, c, t, g, unknown, or other
  misc_feature (13)..(13): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
ggccccccccncnttttgtgggacacccanccctnnttttttcnnnnnnnnnannctgggactccccgcggtggcggccgctctagaactagtggatcccccgggctgcaggaattcgcacgagaccattacctagaacatcctaatcaaaaaatctgccatcttcgtctatccctttcatctcagttttgcagtttctactgctgtcttcgctccgaaatccaaccgaaatctcagaggaaagtaggaaacctcgttcgggaacctgctttgagtgagactccaatccttgggcgccattgccgcctgttttttgtgctcggaaaggcgcttgtctgattcctgtatatttattttggcaatggctttcagctgcaacaaacctaaccatggatgggccctagctttgacctgacaaagcaacgaaggtttaaattttggcctccctttccaaacccaaactttttttaaggaagggaaattgaaccccaaccacaaggggcttggttttccccaatagagattcccttcccggggaaaacaaaagggggtttaacccccgaaaaaacaaaaattttgggggggcacccttttaatttcaaagggacgtgggaccaaaaagaaaaacggccctacttagggttccccaaaagaaaccccaggtcccccacacccaattttggttaaaggaaaaaattcccatttttccgcaaaagcgtccccgcccgttttgagaaggggagtcctttaacaagtcgcatgcgccccccgggagaaaatttcccccgcacaaaatttttgtgaggggggggttccccaaaaaccctggttc

SEQ ID NO: 40453 - DNA, 888 bp, Zea mays
  misc_feature: Ceres CLONE 1433094-F
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
  misc_feature (55)..(55): n is a, c, t, g, unknown, or other
  misc_feature (641)..(641): n is a, c, t, g, unknown, or other
ggggggggtcggtttntggnncccccccccccncaacaaaagcccgccccccttntttgtgggactccccgcggtggcggccgctctagaatagtggatcccccgggctgcaggaattcgcacgagaccattacctagaacatcctaatcgaaaactcgttgcccgttgtgctctctctctctattcgttccccgcctcaccccgagccagccgtctcgctagggtttcgccgccgccgccgccgccggccgcgggtatgcctcgccgcagctcaggagggtctgccccacgcccaagtacgcgtgctgctccagagaggaaaccccccacagccagggcgctagggttcctcctgaggggtgccggttgaaaaaggggggtgggtactatggtttggaaggaatttggggctcccctttgctccggagtacgggcgtttttgtaaaacatacaccccaatggaccagcggggcgtgttagagtctttttattaccgcccgcccagacccctcacagacatcggaatcttgattgcgcccctatcaacgcagtgtgtccagaaggaccccacccgccctcccgcaggggggaaaacacacgcctgatctgctttacctcaacccttttcccgcctatatcngctttacccacacacataccgcgtcaaaaaagcgggggtgtgccaaacccataagatacaaataccacattaaaaaattaatagtagaggaggaggcatagagggggggagccacggcctcccacctcctgacgaccacgcctggctcccccttcctttggtgcgcgttttgtagggcgaagaaagattggttgtgctgtttttgtagacgagcaacatatagccatctttcatcgcataaccaaag

SEQ ID NO: 40454 - DNA, 774 bp, Zea mays
  misc_feature: Ceres CLONE 1433095-F
  misc_feature: Encodes the peptide sequence at SEQ ID NO. 40455
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (33)..(33): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (774)..(774): n is a, c, t, g, unknown, or other
nggttggccccnnnnnnncnnnnanaaaaaaanggaaggagggnnnnnnnnnnnnaaagctggggctccccgcggtggcggccgctctattctagtggatcccccgggctgcaggaattcgcacgagaccattacctagaacatcctaatcgaaaaaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcaaaccaccagaagctggccgccgacgggctgcggttccgccgcgtggtgcgcggcgagcagcaggtctggtccgggatgaacaaccgcctctacgtcaacgccgccaaccccgccggccgccccgggccctaagtcgccgccgtgtacaagcaggtctggacccgcacccgggagctcgcctcctttaacccggggcccccgggcccccgtgaaaccattccggaaccgcgttggggcccgaagtcgcaccccaaaggaagggttcccccggccaatttacggtggccggcgccagccctaagcaggttgggttgcccatgtgagtaacaaaaaagaggcgtttcgccgcgaggggcccagagagggagaggcn

SEQ ID NO: 40455 - protein, 104 aa, Zea mays
  misc_feature: Ceres CLONE 1433095-F
MATHRHCLPLLLVAAALALAAVPARAALGGGRGPLLGGWNPIPDVSDSHIQELGGWALGQANHQKLAADGLRFRRVVRGEQQVWSGMNNRLYVNAANPAGRPGP

SEQ ID NO: 40456 - DNA, 702 bp, Zea mays
  misc_feature: Ceres CLONE 1433101-F
  misc_feature: Encodes the peptide sequence at SEQ ID NO. 40457
  misc_feature (702)..(702): n is a, c, t, g, unknown, or other
tctgaactagtggatcccccgggctgcaggaattcgcacgagaccattacctagaacatcctaatcgaaaaacttcccgtgtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccaccataacaaaaggatgagctgccctgccatggcacagctcctctccaataccctgtactacaagcgcttcttcccatattacgccttcaatgtgctcggtgggcttgacagcgaggggaaagggtgtgttttcacctatgatgcaataggttcccatgacagaactggttatagtgctcagggaacggggatctactttgattatgccagtgcctggaaaaatcaattaaaattcaccaagtccctctattggctcccctggccaggaatgctggtcaccaccaattgttccggaattcaaaaggcccatccan

SEQ ID NO: 40457 - protein, 186 aa, Zea mays
  misc_feature: Ceres CLONE 1433101-F
  misc_feature (10)..(167): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALHKNLAARELLYQHHHNKRMSCPAMAQLLSNTLYYKRFFPYYAFNVLGGLDSEGKGCVFTYDAIGSHDRTGYSAQGTGIYFDYASAWKNQLKFTKSLYWLPWPGMLVTTNCSGIQKAHP

SEQ ID NO: 40458 - DNA, 702 bp, Zea mays
  misc_feature: Ceres CLONE 1433109-F
  misc_feature: Encodes the peptide sequence at SEQ ID NO. 40459
  misc_feature (351)..(351): n is a, c, t, g, unknown, or other
aaagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatcaggtcggaacgcgtgctgggagctgtactgcctcgagcatggattcaggctgatggcagatgcccggtgacaagacattnggggaggtgatgatgctttcacacctttctcagtgagactggccctgggaagcacgtccccccgtgctgttttttgtggaccttgagcccactgtcatcgatgaggtgagggactggacttattcgccaagttttccatcctggagaatttatcgtgggcagggggatcccccaaaaacttcctcggggcccaaacccttggacaaggaaattttaaccttgcccttaccccctgggaatttggaaaatttgccggggcccggggtttcccctttaaacctttttggggaaaaagttttgggtttggttccccccccaggagccctttttttttatttggaaaactccctc

SEQ ID NO: 40459 - protein, 43 aa, Zea mays
  misc_feature: Ceres CLONE 1433109-F
  misc_feature (41)..(41): Xaa is any aa, unknown, or other
MRECISIHIGQAGIRSERVLGAVLPRAWIQADGRCPVTRHXGR

SEQ ID NO: 40460 - DNA, 684 bp, Zea mays
  misc_feature: Ceres CLONE 1433113-F
  misc_feature: Encodes the peptide sequence at SEQ ID NO. 40461
  misc_feature (471)..(471): n is a, c, t, g, unknown, or other
  misc_feature (502)..(502): n is a, c, t, g, unknown, or other
  misc_feature (532)..(532): n is a, c, t, g, unknown, or other
  misc_feature (563)..(563): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
ctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcactcattggtacaaaccatcagggcacagcagctgcagcaactcgtgctacctgtgatcaccaagtagctctggcaaacctttcntcctactctcagcaacaacaatttcttccantcaaccaactgtctacattgaacgtgctgnctattgcagcacaactattaccatcagcagntagtactgctactctagaacacacttctcataacatgcgctgacctgtttgggaactactcatggatcggcnnnnnnnnnnnnnnnnnnnnnnnnnnnnnnnnnnnnnnnnnnnnnnnnnn

SEQ ID NO: 40461 - protein, 104 aa, Zea mays
  misc_feature: Ceres CLONE 1433113-F
MATKIFSLLMLLALSACVANATIFPQCSQAPIASLLPPYLPSMIASVCENPALQPYRLQQAIAASNIPLSPLFQQSPALSLVHSLVQTIRAQQLQQLVLPVITK

SEQ ID NO: 40462 - DNA, 862 bp, Zea mays
  misc_feature: Ceres CLONE 1433116-F
  misc_feature (21)..(21): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ggtttaccggggggagcgagnggggnntnttnnnnnnnatnnnnnnnaacactggagctccccgcggtggcggccgctctagaatagtggatcccccgggctgcaggaattctcacgagaccattacctagaacatcctaatcgaaaacaatatatccccagtcttcgcctcctttctggagcagctagggttccgtcctcgatccgatccgccgagggcacaccatgctttccccactctgatcgaatcgatggacgccgagggcgagaagaagatgataaccctcaaaagctccgatggacaggagttctaggtgggaagaggcggtggccatggagtctcggaccctccgcgcgcggagtcgaggatgagtggggcggggaggggatccctctcccgagcgtcagctccgggaggggggggaagtgtaaccgaagaactggagacgaacaagtttggggtggtcctccggggcccccccccctcctctggagggcgcgatgcggaaccaccggggggggggggggtggccgcacataaaccacaccgtacctccagggggagggcccggccgggggcttgggagtgggtttcattgccctctccgcttccggggacggtccgggggggtgaaaggagcctcgtgtggtttgcttgagtgggcttcggtggggggactggtggggcgggtcggggcggggacgggtgtgcagtgctgggaaagggtgagcggcggtgggggtcgagggggcccccgtgggagtccgggtgggagcggcccggcggggtaatgcggagcgggcggcacggacctaaccttccatacccgtctgagcatatagagagtggagtgggccaccg

SEQ ID NO: 40463 - DNA, 742 bp, Zea mays
  misc_feature: Ceres CLONE 1433117-F
  misc_feature: Encodes the peptide sequence at SEQ ID NO. 40464
ccccgcggtggcggccgctctagaactagtggatcccccgggctgcaggaattcgcacgagaccattacctagaacatcctaatcgaaaattcctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgaaagcactacgccgatctcgcctcaaggccttctccagggcctcgtggatacatcatctctggcccggtggtggccatgggctggaaggaaaaaacttcctccaactgggcccaaagaaattgggccccccaccccctgggttttaagcccggacccttcggggggactttgttgtaccctttgggggaaatttctttttgggaagggcaccctttgaaagggttaaaaaggagatgcccccttggtcccccagaggcccctttgttttggaaaaaacccccccccccccttgtatttccaaaaaaaaaaaagggggaaatttccccccaccccctcttgggaaaacaaaaaagaaacggcccccccttttttggttttaacaaggtttcccaaaaaaaaaaaaaatatctttgttttgtggcgccccctttttttgggggggcaccat

SEQ ID NO: 40464 - protein, 117 aa, Zea mays
  misc_feature: Ceres CLONE 1433117-F
  misc_feature (2)..(117): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAESTTPISPQGLLQGLVDTSSLARWWPWAGRKKLPPTGPKEIGPPTPWVLSPDPSGGLCCTLWGKFLFGKGTL

SEQ ID NO: 40465 - DNA, 731 bp, Zea mays
  misc_feature: Ceres CLONE 1433118-F
  misc_feature: Encodes the peptide sequence at SEQ ID NO. 40466
  misc_feature (435)..(435): n is a, c, t, g, unknown, or other
  misc_feature (459)..(459): n is a, c, t, g, unknown, or other
  misc_feature (471)..(471): n is a, c, t, g, unknown, or other
  misc_feature (474)..(474): n is a, c, t, g, unknown, or other
  misc_feature (492)..(492): n is a, c, t, g, unknown, or other
  misc_feature (519)..(519): n is a, c, t, g, unknown, or other
aaagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgtcctactacgccgggtgtgggcagccgagcgccatgttccagccgctccggcaacagtgctgccagcancaaatgaggatgatggacgtgcantccgtcccgcancanctgcaaatgatgatgcanctggagcgtggccgctgccgccagcancagcctgtgacgacccacttctgatgcaacagcaacaacaacttgctgggagccaagggtctcacaccccagggccatgaagaagggcccaaaacctgcccgccatggggggaattttaaaaaaaccggtggccaatttaccgcccaaccccgtggggggtcccccgggcaattcccccctaaaaggggattcgggattttgggaaaccccc

SEQ ID NO: 40466 - protein, 125 aa, Zea mays
  misc_feature: Ceres CLONE 1433118-F
  misc_feature (90)..(90): Xaa is any aa, unknown, or other
  misc_feature (98)..(98): Xaa is any aa, unknown, or other
  misc_feature (102)..(102): Xaa is any aa, unknown, or other
  misc_feature (103)..(103): Xaa is any aa, unknown, or other
  misc_feature (109)..(109): Xaa is any aa, unknown, or other
  misc_feature (118)..(118): Xaa is any aa, unknown, or other
MKMVIVLVVCLALSAASASAMQMPCPCAGLQGLYGAGAGLTTMMGAGGLYPYAEYLRQPQCSPLAAASYYAGCGQPSAMFQPLRQQCCQXQMRMMDVXSVPXXLQMMMXLERGRCRQXQPVTTHF

SEQ ID NO: 40467 - DNA, 738 bp, Zea mays
  misc_feature: Ceres CLONE 1433121-F
  misc_feature: Encodes the peptide sequence at SEQ ID NO. 40468
  misc_feature (658)..(658): n is a, c, t, g, unknown, or other
aaagctggagctcaccgcggtggcggccgctctagaactagtggatcccccgggctgcaggaattcgcacgagaccattacctagaacatcctaatcgaaaaactcgctctctcccctctggctctgagtggcgctagtgggcgaccgccgccgcgtccctccgtcaggtgcccaggtgtagcctcgtcggcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcangaaacttattcacgtgggagtattctgcaagtcccagactgtgcacagtacttcatggaaaatttggacagattatctga

SEQ ID NO: 40468 - protein, 156 aa, Zea mays
  misc_feature: Ceres CLONE 1433121-F
  misc_feature (23)..(156): Pfam Name: G-alpha Pfam Description: G-protein alpha subunit
  misc_feature (130)..(130): Xaa is any aa, unknown, or other
MSVLTCVIESMGSSCSRSHSFDEAEAAENAKSADIDRRILQETKAEQHIHKLLLLGAGESGKSTIFKQILYEGAKELAQVEPDSSKYVLSPDNQEIGEKLSEIGARLEYPSLNKERVQDVRKLWQDPAIXETYSRGSILQVPDCAQYFMENLDRLS

SEQ ID NO: 40469 - DNA, 727 bp, Zea mays
  misc_feature: Ceres CLONE 1433127-F
  misc_feature: Encodes the peptide sequence at SEQ ID NO. 40470
  misc_feature (576)..(576): n is a, c, t, g, unknown, or other
aaagctggagctccccgcggtggcggccgctctagaactagtggatcccccgggctgcaggaattcgcacgagaccattacctagaacatcctaatcgaaaaattttcatttccccacctctctaaaaccctcgctcttgcccgctgttttacacctaaaagaaaggtcctcgccgtcgagccgccggctcccatctcccgcgccgtcgccgacgaggacacaccagacgcctcgctgatggccttggctcgcctcggacggtctcttgccggccgcctccaccgttctatctaccgtccaccggcgcccacagactaccatgcctccgtttcccgacccttcgctccgacccacacaggcgtatgcgtacgaggtttttgcagcttgacgtacaatgccagcagcatgattggccacaatctcgaggggcccgttgccagtccacatttgtgagggttctggatctcgtagtacatatgaatcatgctagaccgatgtcaacagcagcagcatcaaaggggcctgttgaaccccggaggttggtctgaagggtgccatgaagaatcccggtttcnaaaaataagccgtaacggccagggggacccctttccctttgggaagaaaggttaaccccaaatgggctggagaaggcaaagggggaaattcttttggaaaaaaaaaaccccatttcttttttcagggttgaaaaaaaaaagggggatccca

SEQ ID NO: 40470 - protein, 71 aa, Zea mays
  misc_feature: Ceres CLONE 1433127-F
MALARLGRSLAGRLHRSIYRPPAPTDYHASVSRPFAPTHTGVCVRGFCSLTYNASSMIGHNLEGPVASPHL

SEQ ID NO: 40471 - DNA, 731 bp, Zea mays
  misc_feature: Ceres CLONE 1433129-F
  misc_feature: Encodes the peptide sequence at SEQ ID NO. 40472
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaacgtgccacacatccatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccagggcgagcgtgtactacgagaagatcgtgcgcgacacctgccgcgagatcgggtttcacctccgagacgtggggctcgacccccaccgctgcaaggtgcttgtgaacatcnaggagcagtcccccgacatccggcagggggtggccgggcaccttcccgaacccgccccaggaaaatctggcccgggcaacagggggcccatgtttggggtacccccccggaagaaccccccaaagttaatcccctaaaacccggtgtgggccccaaaagttgggcggcccccaaaaggaaccccccaggagggctccttggccgtgtttagccccccgggaaaacaccgc

SEQ ID NO: 40472 - protein, 143 aa, Zea mays
  misc_feature: Ceres CLONE 1433129-F
  misc_feature (4)..(103): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
  misc_feature (99)..(99): Xaa is any aa, unknown, or other
MAAESFLFTSESVNEGHPDKLCDQVSDAVLDACLAQDPDSKVACETCTKTNMVMVFGEITTRASVYYEKIVRDTCREIGFHLRDVGLDPHRCKVLVNIXEQSPDIRQGVAGHLPEPAPGKSGPGNRGPMFGVPPRKNPPKLIP

SEQ ID NO: 40473 - DNA, 715 bp, Zea mays
  misc_feature: Ceres CLONE 1433139-F
  misc_feature: Encodes the peptide sequence at SEQ ID NO. 40474
  misc_feature (455)..(455): n is a, c, t, g, unknown, or other
  misc_feature (460)..(460): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcnacagncgcgtggacgcctacgtctcccgctccgggaggggcgagtgccggcgccagtgcctgcccccgcacgagggccagcccgtggagatctaggagtgcatgaggcggtgccgccgccgccgactggccttcaacatgaagcaaaagtacggtcccggcaccaaaaccccgggcaaatgccgggaaaaggtccaacccccccccccggggaacttgtggaaaaggcaccctcctttatgactcagaaacccccggggg

SEQ ID NO: 40474 - protein, 111 aa, Zea mays
  misc_feature: Ceres CLONE 1433139-F
  misc_feature (81)..(81): Xaa is any aa, unknown, or other
  misc_feature (82)..(82): Xaa is any aa, unknown, or other
MGKGSVGASWWAFLLLAGVLLVVAATAGAEDGVVERDRKEDLRWCKQACEWQYGKDTPRKRECESECRERHQQADAGEDGXXRVDAYVSRSGRGECRRQCLPPHEGQPVEI

SEQ ID NO: 40475 - DNA, 677 bp, Zea mays
  misc_feature: Ceres CLONE 1433141-F
  misc_feature: Encodes the peptide sequence at SEQ ID NO. 40476
aaactggagctccccgcggtggcggccgctctagaactagtggatcccccgggctgcaggaattcgcacgagaccattacctagaacatcctaatcgaaaagtttttaactaagctttaatggccttctctctatatataaacggttagtgatcttttcaggttactaaaatccaccaaaaaatgtctctagtccattatgccatcctcgtggcacttcttgtcatctccgccaatgcagtctctcctccagagaagttgaaacccaaacaaaccgttcctgcttctcctacaatctctgctgccgccaaagctttcaccgacgcgcacaacaaggccagagccatggtaggtgtcccaccgctagtatggagccagacgctggaggcggcggcgaaccggctggctcgttaccagaggaaccagaagaaatgcgagtttgcgagtctaaaccctgggaaatacggcgcgaaccagctttgggccaaaggtttggccgtgacgccgactcttgcggtggagacatgggtgaaggagaaacctttctacgactacaagtcggacaaatgtgccccgaaccacacgtgtggtgtctataaacaagtcgtgtggagagactcaaaggagctaggctgtgctcaagccatgtgtactaaagagtcaacggttttaaccatt

SEQ ID NO: 40476 - protein, 165 aa, Zea mays
  misc_feature: Ceres CLONE 1433141-F
  misc_feature (46)..(165): Pfam Name: SCP Pfam Description: SCP-like extracellular protein
MSLVHYAILVALLVISANAVSPPEKLKPKQTVPASPTISAAAKAFTDAHNKARAMVGVPPLVWSQTLEAAANRLARYQRNQKKCEFASLNPGKYGANQLWAKGLAVTPTLAVETWVKEKPFYDYKSDKCAPNHTCGVYKQVVWRDSKELGCAQAMCTKESTVLTI

SEQ ID NO: 40477 - DNA, 683 bp, Zea mays
  misc_feature: Ceres CLONE 1433142-F
  misc_feature: Encodes the peptide sequence at SEQ ID NO. 40478
tggcggccgctctagaactagtggatcccccgggctgcaggaattcgcacgagaccattacctagaacatcctaatagaaaaattttcccactcgatcgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacaagaggccttactacggcggcggcggcggcggtcttggtggcgcctacggaggcggtggctccgagtacggccacgagggccgaccgcaccacggcggcggcggaatccagtacggccacgagacacgccccgcaccacggcggcgggggcgggcgctccgccctgtgaggcagccagacgttacgggatctactggcaagggctgggggaggaccagtaacagtcttcccttccggcgaacggaaagggcctgccttccggcggcccgggaccggggatgacc

SEQ ID NO: 40478 - protein, 191 aa, Zea mays
  misc_feature: Ceres CLONE 1433142-F
MEFPHHHHHHGHRRDDDEDDRRGPPPPVYGGYGQPPPPDPYGRAPVDPDPYGRPPPQSAYGGAGDAYGHSGQGYAPPPAYGAGGGYGNVVHVAHEVGDKRPYYGGGGGGLGGAYGGGGSEYGHEGRPHHGGGGIQYGHETRPAPRRRGRALRPVRQPDVTGSTGKGWGRTSNSLPFRRTERACLPAARDRG

SEQ ID NO: 40479 - DNA, 740 bp, Zea mays
  misc_feature: Ceres CLONE 1433143-F
  misc_feature: Encodes the peptide sequence at SEQ ID NO. 40480
  misc_feature (599)..(599): n is a, c, t, g, unknown, or other
  misc_feature (616)..(616): n is a, c, t, g, unknown, or other
  misc_feature (617)..(617): n is a, c, t, g, unknown, or other
aagctggagctccccgcggtggcggccgctctagaactagtggatcccccgggctgcaggaattcgcacgagaccattacctagaacatcctaatcgaaaatcccacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggcgagcaggcgggaatctccgccgtcatcccaggatggttctccgagatcagccccatgtggcccggtgaggcgcactccttgaaggtggagaaggttctgttccagggcaagtcagactaccaaaatgtgatggtttttcagtcctccacgtacgggaaggtgcttgtcctcgacggagttattcaggtgacagagagggatgagtgcgcgtaccaagagatgattactcacctgcccctttgctccatcaaagaccccaagaaggtgttggttattgagggggattnggtggtgggtttttttnncgggaggtttcacgggcatatctcctgtggagcagattgacatctgtgaaattgataagatgggtggtagatgtctccaagcaatttttccctcatctagctgttggatttgaagaccctcgg

SEQ ID NO: 40480 - protein, 146 aa, Zea mays
  misc_feature: Ceres CLONE 1433143-F
  misc_feature (43)..(146): Pfam Name: Spermine_synth Pfam Description: Spermine/spermidine synthase
  misc_feature: SWISSPROT Homolog: EC 2.5.1.16 Spermidine synthase
  misc_feature (128)..(128): Xaa is any aa, unknown, or other
  misc_feature (134)..(134): Xaa is any aa, unknown, or other
MEAEAAAKRAREGGEDATAPVAGAEAVVAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIEGDXVVGFFXGRFHGHISCGAD

SEQ ID NO: 40481 - DNA, 735 bp, Zea mays
  misc_feature: Ceres CLONE 1433144-F
  misc_feature (375)..(375): n is a, c, t, g, unknown, or other
tggagctccccgcggtggcggccgctctagaactagtggatcccccgggctgcaggaattcgcacgagaccattacctagaacaacctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaatttctgaaccctacaggatccaacaggcaatcgcagctggcatcttacctttatcacccttgttccntccacaatcatcacccctattacagcagttacctttgggtgcattattggcccaaacatcaggccccacaactacaaaaacttggctagaaaccttttttgctaacttaaaaaaaggagtttttttcctttaacccaaaaggtgcttgaaacctgcttttttttgccaaaaaaaaaattactttttggcggttctctgttgctcaccccaaaattttttctctttaacacaaggggagaattgaaacccctcgctttttttccgccccccaaccccccccccccatttttgtggtttttaaaaaaacgggggccaaaaagggggccccttaaaagaaggaaaaatggggcctcaaacacc

SEQ ID NO: 40482 - DNA, 772 bp, Zea mays
  misc_feature: Ceres CLONE 1433149-F
  misc_feature: Encodes the peptide sequence at SEQ ID NO. 40483
  misc_feature (260)..(260): n is a, c, t, g, unknown, or other
  misc_feature (714)..(714): n is a, c, t, g, unknown, or other
  misc_feature (715)..(715): n is a, c, t, g, unknown, or other
aagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgaaagcccgaacagatcttcaattccccattccgcccaccgatcgaccttcacgccagtctcggtctcttccgaaggcgtcgcgcgcggttgtttgagaggagaggagaangatgagggagtgcatctcccgtcacatcgggcagggcgggcatccagtcggcaacgcgtgctgggaactttactggctcgagcacggcatccagcctgaatgccaaatgcctggagaaaaaacggcgggaaatcacgataatgcctttagacctttcttaaccaaaatgggggttggaaagccgtttcccggggaaattttcgttaaatttaaaccccccggtgaaccaaagagggggcaatgggacaaaaccccccttttttccccccggggagatctttttgggggggggggggggagccccaaaaaaatttcccccgggggccccccacaattgggaaaagaatttgtttcttgtgtgccttccacctccccccaaatttgttaaaaaaacccccccccccccggggtgttttgtgttttaaaaaagtgggggggggggaaaaaacccccnnttttttttcctccccccggggggggggggggggggggagaagaaaaaaaaaaaccca

SEQ ID NO: 40483 - protein, 128 aa, Zea mays
  misc_feature: Ceres CLONE 1433149-F
MRECISRHIGQGGHPVGNACWELYWLEHGIQPECQMPGEKTAGNHDNAFRPFLTKMGVGKPFPGEIFVKFKPPGEPKRGQWDKTPLFSPRGDLFGGGGGSPKKISPGGPPQLGKEFVSCVPSTSPQIC

SEQ ID NO: 40484 - DNA, 780 bp, Zea mays
  misc_feature: Ceres CLONE 1433161-F
  misc_feature: Encodes the peptide sequence at SEQ ID NO. 40485
  misc_feature (421)..(421): n is a, c, t, g, unknown, or other
aaagctggagctccccgcggtggcggccgctctagaactagtggatcccccgggctgcaggaattcgcacgagaccattacctagaacatcctaatcgaaaaacttctctgcttccgacctcgtagcgaatcggaccggggggctagggttccggtgcgcctctgcaatcggacgcgaggctaggctgggcatggagggaaccgctgcggcccggaagaggtcccggccggagacggcgaacggggctgccgccgccgggaagcgttccaaagtacgattgggtgcccgtttggcgagggatgtcattttctgcactttgtccctggtgggtacgcggcagttgcaaaaatgctgaatctaggtagctctgctgtatctgcgcccatcagaactcatgtggatcatggccgctctaacggntgcttctcatccagcttctacggtcaagaaccccctgggcacaaagtacaaccctccaaaaggcgtcaagttccggaaaaaaagcccctttcccccaaacaaaagaaaagttttgaaaacccccctcatttttaaaaagaggccccccttggggggggaaaatttgggaaattttaccttttgccccgtcgccgtggggccccccccagaaaaaaatttggcccccccccgaccccacaaataggggcggcccccctcgcggggggggaaaaaagagggggggggggagccaaccacaaaaaaaaaataaaaaagaggggggttttcttcccccccacgagggttcccccccaaaaaaa

SEQ ID NO: 40485 - protein, 68 aa, Zea mays
  misc_feature: Ceres CLONE 1433161-F
MLNLGSSAVSAPIRTHVDHGRSNGCFSSSFYGQEPPGHKVQPSKRRQVPEKKPLSPKQKKSFENPPHF

SEQ ID NO: 40486 - DNA, 701 bp, Zea mays
  misc_feature: Ceres CLONE 1433162-F
  misc_feature: Encodes the peptide sequence at SEQ ID NO. 40487
ggcggccgctctagaactagtggatcccccgggctgcaggaattcgcacgagaccattacctagaacatcctaatcgaaaaatcacgcaatcgagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtactccccagagaacgagaagttcaacgattttgctaatgaggatgcacttatttggcacgaggcaaacataccatatgcagtctggggacctaccagtactagaacacggtcattaacgtactatccgtcagaggctctcaagcataatggctctttgtatgctcatgtttacttcgcccgttcgggttatcctgtggaccctaccgatcccgaatatgagcagaaatcttcctttgggaggacccatcctgttgtggcattcttgcccaaatccaaacggggtaaaaagaagagcttggttt

SEQ ID NO: 40487 - protein, 175 aa, Zea mays
  misc_feature: Ceres CLONE 1433162-F
MSQPAATVAAAAQPQGRGPAGRQGGLGQSIAGIVRMAVFWYFASKFFGPKRPPADPGMLMSNLFQKGEPMDMWMYSPENEKFNDFANEDALIWHEANIPYAVWGPTSTRTRSLTYYPSEALKHNGSLYAHVYFARSGYPVDPTDPEYEQKSSFGRTHPVVAFLPKSKRGKKKSLV

SEQ ID NO: 40488 - DNA, 683 bp, Zea mays
  misc_feature: Ceres CLONE 1433165-F
  misc_feature: Encodes the peptide sequence at SEQ ID NO. 40489
  misc_feature (337)..(337): n is a, c, t, g, unknown, or other
  misc_feature (514)..(514): n is a, c, t, g, unknown, or other
  misc_feature (515)..(515): n is a, c, t, g, unknown, or other
tggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccanttgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccnnacactttgccggtggtcactacaccattggcaaggagatttgtgacctatgccttgatcgcatcaggaagcttgcgaacactgcactggtctccagggcttcctccgcttcaaccttgttggtgaaagaacggctcctggcctggttcccctctcccaaaaggccggg

SEQ ID NO: 40489 - protein, 129 aa, Zea mays
  misc_feature: Ceres CLONE 1433165-F
  misc_feature (22)..(125): Pfam Name: Tubulin Pfam Description: Tubulin/FtsZ family, GTPase domain
  misc_feature (15)..(15): Xaa is any aa, unknown, or other
  misc_feature (74)..(74): Xaa is any aa, unknown, or other
MAFRLTVRCPVTRPXGGGDDAFNTFFSETGAGKHVPRAVFVDLEPTVIDEVRTGTYRQLFHPEQLISGKEDAAXHFAGGHYTIGKEICDLCLDRIRKLANTALVSRASSASTLLVKERLLAWFPSPKRP

SEQ ID NO: 40490 - DNA, 723 bp, Zea mays
  misc_feature: Ceres CLONE 1433172-F
  misc_feature: Encodes the peptide sequence at SEQ ID NO. 40491
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctctttgtccacgcttgtctgagctcctttggagtgaagtcgtgatggccaatgattgcattggtgaagaagttgagaaagttgctgccgctttgccagaggtggagttctgctcctaggagatgttagatcctacanggaggaagagaagaacgaccttgagttgctaaaagctagcatctggtgcgacctttaggcaagatgcttttggaccggcccaaagttttgttttcccccgagggatttcccagttttaaaacctgtttttgctgggttccccaagaaaaagattttaa

SEQ ID NO: 40491 - protein, 117 aa, Zea mays
  misc_feature: Ceres CLONE 1433172-F
  misc_feature (3)..(118): Pfam Name: PGK Pfam Description: Phosphoglycerate kinase
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVILASHLGRPKGVTPKYSLKPLCPRLSELLWSEVVMANDCIGEEVEKVAAALPEVEFCS

SEQ ID NO: 40492 - DNA, 696 bp, Zea mays
  misc_feature: Ceres CLONE 1433176-F
  misc_feature: Encodes the peptide sequence at SEQ ID NO. 40493
  misc_feature (631)..(631): n is a, c, t, g, unknown, or other
aaagctggagctccccgcggtggcggccgctctagaactagtggatcccccgggctgcaggaattcgcacgagaccattacatagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcgtccgggctagacgccgacggcggcaagcggagccatttctccagcatcagaagtgacgacggccagaggtcgctcgacgcagtggtaaaaacggccggcaaggaggccttccagtggggttagtggtgtgattagtctgttcaaatctaacagtacgttggaggtccacaagtagtataaccctgtttctctcgacctcgacatgcagggttggcagccggagtctactcanggctcacgtacgcgctgcgggaggccaggggatgccacgactgggtcagtgctattcctagcttt

SEQ ID NO: 40493 - protein, 104 aa, Zea mays; identical to SEQ ID NO: 33609
  misc_feature: Ceres CLONE 1433176-F

SEQ ID NO: 40494 - DNA, 680 bp, Zea mays
  misc_feature: Ceres CLONE 1433202-F
  misc_feature: Encodes the peptide sequence at SEQ ID NO. 40495
aaagctggagctccccgcggtggcggccgctctagaactagtggatcccccgggctgcaggaattcgcacgagaccattacctagaacatcctaatcgaaaaaaaacaagaccgccgcaccatggaatcgctgacgcttcgggcttcgacggccgcctcgccgctgcagcgacgccggctgctcctcggacggcagcgcgcgacgtacgtccgcgccgcggcctccgccggcgagccggacctctccgtgctcgtgaacgggctgcacatgcccaacccgttcgggatcgggtcggggccaccggggaccaactacaccgtcatgaagcgcgccttcgacgagggctggggcgccgtcatcacctagactgtgtcagtggatgctgagaaagttatcaactttactcccccccacccacggcttcgggcagaacccaatggggctgccctggggcgcgtcattgggtgggaaaacattgaactcagcagtgacagggctctggagaccatgctcaatgagtgcaagccgttgaataaagaggatcctggcgggatacttatcgcgtcacttatggagggagtcaacaaagcggcgtgggatgagcttataggacggtgtttgaacagtctggaatgggatgctcttggaagttaatttccccatgggccccatggccatg

SEQ ID NO: 40495 - protein, 81 aa, Zea mays
  misc_feature: Ceres CLONE 1433202-F
  misc_feature: SWISSPROT Homolog: EC 1.3.1.2 Dihydropyrimidine dehydrogenase (NADP(+))
MESLTLRASTAASPLQRRRLLLGRQRATYVRAAASAGEPDLSVLVNGLHMPNPFGIGSGPPGTNYTVMKRAFDEGWGAVIT

SEQ ID NO: 40496 - DNA, 807 bp, Zea mays
  misc_feature: Ceres CLONE 1433224-F
  misc_feature (43)..(43): n is a, c, t, g, unknown, or other
  misc_feature (44)..(44): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (446)..(446): n is a, c, t, g, unknown, or other
ggggggggggtcccccggggggggggtggggtgtgttcggggnngggnnnnnnnaaaagtaggggggcaccccggtggcgggcgctctacaactagaggatcccccgggctgcgggagttcgcacgagaccattacctagaacatcctaatcgaaaaatctgctccgtccctctgctgcgcacaaagagaacactcgagtctggatccctggaccaaccatggggagcgctacacgcggcgagaagaggatcgcttacgacgcgtcgctgtagtgcggtcgtcgagaagttcacacagatcttggccggtgcggccgacaacgcggggtctagtcaccatgtgagagtcacgaagggtcttcgtggagactctgcggtgcctatggggaggaaacgtggaggaagcgttctgtgtaagagtaactctgaaaacactgaaaaaaaanccatcgtcaaagctatgctccttcttcccccacacgctggtgttgattcgacaccagctgcggaggtcatggaaagtgagggcacgacagcgggccccgtacagggcttgggaggcggctagcctcgggcgtggtttggtgtgcacctagcggggagtttcgtagtacagggcggggaaactggtggcgcgtgagtcgggatctctcgaccggctgatgcttgccggggggccgtgaagacggcggggacttaggcagggagacgatgggatggcggggggagacccctctgagaggcccagtgggcggcgccgcctgggtggagggcggggaggaggctcccaagggtgctattgtctat

SEQ ID NO: 40497 - DNA, 639 bp, Zea mays
  misc_feature: Ceres CLONE 1433230-F
  misc_feature: Encodes the peptide sequence at SEQ ID NO. 40498
ggagctccccgcggtggcggccgctctataactagtggatcccccgggctgcaggaattcgcacgagaccattacctagaacatcctaatcgaaaaaacaccaccgctcgactgctctcaccgaccagcgctgcgccactcctccgccggatctccagcatgcagccctcctcctcgtcctcctccgctcacccgcccgaccatcccaactccaagcccccggccccgccggcccccgccatgggctaccccgccaaccccgcccccaacgggaaccccagcgcctacttcgccgccgcgccgcccgccgccgccgccgccaacggctccgctccggcgtccttcggcgtcgcctacccctaccccgcccctcctcagcaccgtcacccgccgccgcaccaccactacccgtaccccccgcccccgccgacgcaccaccactacgcggcccacccgccgccgccgcccacctgcctgcgacgactcctcgccgccgtcgttggcgccttacttctcctcggcgccgccaccttcatagtgtgggtcctgctccgcccgcggggcccggccttctccctcacctccctggacctctcccgcgtcgcttactccctcgccaactcctcactcgtcgcctcg

SEQ ID NO: 40498 - protein, 160 aa, Zea mays
  misc_feature: Ceres CLONE 1433230-F
MQPSSSSSSAHPPDHPNSKPPAPPAPAMGYPANPAPNGNPSAYFAAAPPAAAAANGSAPASFGVAYPYPAPPQHRHPPPHHHYPYPPPPPTHHHYAAHPPPPPTCLRRLLAAVVGALLLLGAATFIVWVLLRPRGPAFSLTSLDLSRVAYSLANSSLVAS

SEQ ID NO: 40499 - DNA, 656 bp, Zea mays
  misc_feature: Ceres CLONE 1433237-F
  misc_feature (404)..(404): n is a, c, t, g, unknown, or other
  misc_feature (408)..(408): n is a, c, t, g, unknown, or other
  misc_feature (501)..(501): n is a, c, t, g, unknown, or other
  misc_feature (582)..(582): n is a, c, t, g, unknown, or other
ggagctccccgcggtggcggccgctctagaactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtggggagaaccggaaaggcaggcagagagaggaagganggancccctggaccaagctaagcgcaacagcatgggcccccggatccaggtcctggggggcgctcttggggggcctcgggggaagcacacgccgggntgacggcgccgcttccgcaggactactacgcggcggggggccccgagcctggagagaatcctgcgcccccccgggtccaanaaagggcaaggccaacccctccccctggggggccacattcgcctcttctttcaccaatgcttccttcaagggtg

SEQ ID NO: 40500 - DNA, 655 bp, Zea mays
  misc_feature: Ceres CLONE 1433257-F
  misc_feature: Encodes the peptide sequence at SEQ ID NO. 40501
  misc_feature (492)..(492): n is a, c, t, g, unknown, or other
aagctggagctccccgcggtggcggccgctctagatctagtggatcccccgggctgcaggaattcgcacgagaccattacctagaacatcctaatcgaaaaagtcgaccaggtcctccaccgcaagagacagagaactagagaaagccatagcaagcaaaagcacaggagcgcaagagcccaacaggcgccaagaaagcaccgcccggccggtccgcgccagtatggtgacggcgatcgcggtggcgtcggcggggctcgggatgctggcgggcgtcgcgatggccaacaggtcttcgccgccgtccgcgggcgccgcgctgtggaggcccggcgggggccccgcgctgcgctggggcggaggcaccccgcgctgcgaggcgtgcggggggtcgggcaaggaggactgccgcctctgcgcgcgctggtccgacgcccgcgcccgcgggaagaagaatagccgctccgggtgccgcgcgtgcgcccgcacgcnccagacgccgtgccagtgctgccgctggtacggcaaccggcggcgcgcgcccgtgcggatcgccacgtacgcgcgcaccgcaccgactgggaagtgatgaccacctgaacgtccgtcgcggcgaaccccaacccgaagccgaagccccctctcttcggctctc

SEQ ID NO: 40501 - protein, 121 aa, Zea mays
  misc_feature: Ceres CLONE 1433257-F
  misc_feature (90)..(90): Xaa is any aa, unknown, or other
MVTAIAVASAGLGMLAGVAMANRSSPPSAGAALWRPGGGPALRWGGGTPRCEACGGSGKEDCRLCARWSDARARGKKNSRSGCRACARTXQTPCQCCRWYGNRRRAPVRIATYARTAPTGK

SEQ ID NO: 40502 - DNA, 651 bp, Zea mays
  misc_feature: Ceres CLONE 1433260-F
  misc_feature: Encodes the peptide sequence at SEQ ID NO. 40503
aagctggagctccccgcggtggcggccgctctagatctagtggatcccccgggctgcaggaattcgcacgagaccattacctagaacatcctaatcgaaaaaccactctctccactgtgactccgtgacctggctgccctgctgcacaagcacagcacacacaccccgcacaccgcaccagctcagcgcagctcaccaagacaatcaatcatggctcacccgcgcagtgtcgctgccgctgcccccctcctcctgctgctcgccgccgccgccgccgccacaacggagctcgtgtccgccgcagtctcggcagccagcgacttcatccgcaagtcgtgccgcacgacgcagtacccgtctgagtgcgagcagaccctggcgtcgaacggcgggtcgactccagaccggatcccgcgtgagctggcgcgcgacctgctgtcgatgagcgctgaccacgcgcgcaccgcatcagcatacatgagccgcctgtgctgcaactaatacagacaacgcgcgaagcacgggacgggatcgcactccgcgtcggcatctgcacgtcccgagcgcgactgcccgcactatatggtggacagcctgggccacctccgcaacacgggccatgagatgggccgtctcaggatgggccaggag

SEQ ID NO: 40503 - protein, 96 aa, Zea mays
  misc_feature: Ceres CLONE 1433260-F
MAHPRSVAAAAPLLLLLAAAAAATTELVSAAVSAASDFIRKSCRTTQYPSECEQTLASNGGSTPDRIPRELARDLLSMSADHARTASAYMSRLCCN

SEQ ID NO: 40504 - DNA, 675 bp, Zea mays
  misc_feature: Ceres CLONE 1433262-F
  misc_feature: Encodes the peptide sequence at SEQ ID NO. 40505
  misc_feature (509)..(509): n is a, c, t, g, unknown, or other
aagctggagctccccgcggtggcggccgctctagaactagtggatcccccgggctgcaggaattcgcacgagaccattacctagaacatcctaatcgaaaaacgcgaatcctcaaatctgcccttgccgccgccaccgcccgatccaggtctgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccagcgcctcgtccgcgaaatcgcgcaggacttcaagacggacctgcggttccagtcctcggccgtggcggcgctgcaggaggccgcggaagcgtacctggtggggctcttcgaggacaccancctctgcgccatccacgccaagagggtcacatcatgcccaaggacatccagctcgccccgccaatcagggggcaaaaggggttggagctgccccccctgctgctggttcccccttgaaaacccctaaaaaaaaaagagggggggggctttttttagccgggccttt

SEQ ID NO: 40505 - protein, 150 aa, Zea mays
  misc_feature: Ceres CLONE 1433262-F
  misc_feature (58)..(131): Pfam Name: Histone Pfam Description: Core histone H2A/H2B/H3/H4
  misc_feature (109)..(109): Xaa is any aa, unknown, or other
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTXLCAIHAKRVTSCPRTSSSPRQSGGKRGWSCPPCCWFPLENP

SEQ ID NO: 40506 - DNA, 758 bp, Zea mays
  misc_feature: Ceres CLONE 1433267-F
  misc_feature (61)..(61): n is a, c, t, g, unknown, or other
  misc_feature (81)..(81): n is a, c, t, g, unknown, or other
  misc_feature (82)..(82): n is a, c, t, g, unknown, or other
  misc_feature (89)..(89): n is a, c, t, g, unknown, or other
  misc_feature (90)..(90): n is a, c, t, g, unknown, or other
  misc_feature (299)..(299): n is a, c, t, g, unknown, or other
gttgttcttattcccgtttttgttcttctggctacaagcgcggcggtgttacatccgcagncctgatatttttggtgtgtnnttgtccnnccccaaactggagctccccgcggtggcggccgctctagaatagtggatcccccgggctgcaggaattcgcacgagaccattacctagaacatcctaatcgaaagtagtcgtagctcaagcatcagcggcaggagctctgggcagcgtgcgcacgtggggtacctagctcgctctgctagcctaccatggctgatccacaccggggtgcnacgggaggtgccgggggctacggcgacctccagcccgggggcgggatgccccgggaaggccaccaaccaccaaaccaggggcccctatataggggtctaaagggccgaaaggccccaaacttttggggggggcaaactttggggtttcccgggttaaatccggggccgccccccgggtaccccttcacgggggcccccccccggggggggggaatttttcccccgggggggggggggggggccccccccgggtgggggcctttagggggggggggttttttcccccccccgggggggccccgggcccccccccgccccccgggtttctcccggggggggaaaaaaacccccgggggggggaccccccccgggggggggcgaaaattttgggtacccccccggggggaggggggggggtgttaaaacccccccccccataatggggtggggcccccccca

SEQ ID NO: 40507 - DNA, 664 bp, Zea mays
  misc_feature: Ceres CLONE 1433272-F
  misc_feature: Encodes the peptide sequence at SEQ ID NO. 40508
  misc_feature (535)..(535): n is a, c, t, g, unknown, or other
  misc_feature (631)..(631): n is a, c, t, g, unknown, or other
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatgggggttcctcacgtcgggcgcgctggggcntcggggcctgtccctcgctcacgtgcctcgccaacacggcggcggcaggggtttccaccgcacccccggactacctgggaggaggcgccaccccangaatgggggaggccccccggcccaaccgggccc

SEQ ID NO: 40508 - protein, 155 aa, Zea mays
  misc_feature: Ceres CLONE 1433272-F
  misc_feature (44)..(145): Pfam Name: Oleosin Pfam Description: Oleosin
  misc_feature (144)..(144): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGVPHVGRAGASGPVPRSRASPTRRRQGFPPHPRTTWEEAPPXEWGRPPGPTGP

SEQ ID NO: 40509 - DNA, 621 bp, Zea mays
  misc_feature: Ceres CLONE 1433278-F
  misc_feature: Encodes the peptide sequence at SEQ ID NO. 40510
  misc_feature (91)..(91): n is a, c, t, g, unknown, or other
  misc_feature (273)..(273): n is a, c, t, g, unknown, or other
  misc_feature (354)..(354): n is a, c, t, g, unknown, or other
  misc_feature (366)..(366): n is a, c, t, g, unknown, or other
  misc_feature (408)..(408): n is a, c, t, g, unknown, or other
aagctggagtccccgcggtggcggccgctctagactagtggatcccccgggctgcaggaattcgcacgagaccattacctagaacatcctnaatcgaaaaccttgtcctcgcccctacccccgccaccgccgccgccgtcgccgcagccatggcgtcgcggcgctgtctcctccgcttcctctcgatccgcctcgttcctcagagatctcaacctcttgcgccgatctcgactgcgacccggaccctaacctctttgtccgaggccctcggcntcccagctccccgggccctcgcctccccccggctgtactacccctcgcgctgccacttcgcgacccgctccctcggcgacnaggacgaacganaagacgaagaagagcactacgacgatgaggggagcgatgggncaaggggggaccataaggaggtgggggcgggaaaaaaacggacccggaaaaccccaaaagaaaaaggttcccaaagcccgctaaaaaccgctaccaagggggttgggaccccccccaggcttaaaaataaaccctcttaagcccttaagagcccttttttccccgggaaaaaaaaaggggtccccccccatttttagggggggaaaagggggg

SEQ ID NO: 40510 - protein, 33 aa, Zea mays
  misc_feature: Ceres CLONE 1433278-F
MRGAMGQGGTIRRWGREKNGPGKPQKKKVPKAR

SEQ ID NO: 40511 - DNA, 663 bp, Zea mays
  misc_feature: Ceres CLONE 1433279-F
  misc_feature: Encodes the peptide sequence at SEQ ID NO. 40512
agagctggagctccccgcggtggcggccgctctagaactagtggatcccccgggctgcaggaattcgcacgagaccattacctagaacatcctaatcgaaaaaaaacaagaccaccgcaccatggaatcgctgacgcttcgcgcttcgacggccgcctcgccgctgcagcgacgccggctgctccccggacggcagcgcgcgacgtacgtccgcgccacggcctccgccggcgagccggacctctccgtgcgcgtgaacgggctgcagatgcccaacccgttcgtgatcgggtcggggccaccgggcaccaactacaccgtcatgaagcgcgccttcgacgagggctggggcgccgtcatcgccaagactgtgtcattggatgctgaaaaagttatcaacgttactcctcgttatgcaaagcttcgggcagaaccaaatggggctgccatggggcgcatcattggctgggcagacattgaactcatcagtgacagggctctggagaccatgctgaatgagttcaagcagttgaagaaagagtatcctgaccggatacttatcggttccattatggaggaggaccaccaagctgcatggcatgagcttattggacgtgttgaagaggctggagtggatgctcttgaaataatttctctggccac

SEQ ID NO: 40512 - protein, 180 aa, Zea mays
  misc_feature: Ceres CLONE 1433279-F
  misc_feature: SWISSPROT Homolog: EC 1.3.1.2 Dihydropyrimidine dehydrogenase (NADP(+))
MESLTLRASTAASPLQRRRLLPGRQRATYVRATASAGEPDLSVRVNGLQMPNPFVIGSGPPGTNYTVMKRAFDEGWGAVIAKTVSLDAEKVINVTPRYAKLRAEPNGAAMGRIIGWADIELISDRALETMLNEFKQLKKEYPDRILIGSIMEEDHQAAWHELIGRVEEAGVDALEIISLA

SEQ ID NO: 40513 - DNA, 626 bp, Zea mays
  misc_feature: Ceres CLONE 1433287-F
  misc_feature: Translation starting site: 198
  misc_feature (165)..(165): n is a, c, t, g, unknown, or other
  misc_feature (436)..(436): n is a, c, t, g, unknown, or other
  misc_feature (480)..(480): n is a, c, t, g, unknown, or other
aagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacngtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagccngtgcctggggtggcgggcgccatcgcgctggcgctcatggcggncggggtcgtcacctccggcggcctcggcgtcgctgcgctgtccgtgttctcctggatgtacaagtacctgacgggcaagcacccgccgggcgccgaccagctgggacacgcaaggcgaagctggcgtcccaaggccgcgacatcag

SEQ ID NO: 40514 - DNA, 674 bp, Zea mays
  misc_feature: Ceres CLONE 1433288-F
  misc_feature (32)..(32): n is a, c, t, g, unknown, or other
agagctggagctccccgcggtggcggccgctncatcatacccggatcccccgggctgcaggattccccacgagaccatacctagaacatcctaatcgaaaaagatctagcgccgcctccttcaccctgctgctggccgcctggccggcgagctcctcagcgtggaagaagacaaaaaacgttatagtgaagaggaggggttgattgctgcattcaaaagtgtcggggataccttatccaatgctactgagaaggttgccacaggggacactgatgtgccagatgatctttttatagtttgataaacctttcaggttttgagcagacccacatatctctgtatttcaattatctggtggcgcaccctcacattgctagagccttcaacaagttgtcattcgaccacaagttaatctgggctcgcaatttcgtcagtgaaaagttcctaggagtgtgagggcagttggtaggtaggcttggagggttcttttgcttgaaccacattgaacaatgaactgcgatctatgtgtaaccaggagtgtgagggcagttagtagataggcttggacggttcttttgcttgaactacatcaaacaatgaaatgtcgtctaagtatgtcagcggattttgcttgaacatgcagattttgtggaagccttaaacttgatattatg

SEQ ID NO: 40515 - DNA, 597 bp, Zea mays
  misc_feature: Ceres CLONE 1433296-F
  misc_feature: Encodes the peptide sequence at SEQ ID NO. 40516
acagctggagctccccgcggtggcggccgctctagaactagtggatcccccgggctgcaggaattcgcacgagaccattacctagaacatcctaatcgaaaacatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcaccactaccagggaagggaatttggccccccctgtttttttaaatggtgccccccaccaaaaaaagggggggggggggtcccccccccccacggggagaaaactttttgaaaactgtgtgttcctaagaaaaaaccccccccccctggggggggttgttgtttcttaggggggggaaaaaatcttccccggggagggggggggggggggaaaaaaaaccaccccctttttttttttttttgtgggggggggaagaaaaacacacaaaa

SEQ ID NO: 40516 - protein, 92 aa, Zea mays
  misc_feature: Ceres CLONE 1433296-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEVVEASVHHYQGREFGPPCFFKWCPPPKKGGGGVPPPHGEKTF

SEQ ID NO: 40517 - DNA, 677 bp, Zea mays
  misc_feature: Ceres CLONE 1433311-F
  misc_feature: Encodes the peptide sequence at SEQ ID NO. 40518
  misc_feature (168)..(168): n is a, c, t, g, unknown, or other
  misc_feature (181)..(181): n is a, c, t, g, unknown, or other
aaagctggagctccccgcggtggcggccgctctagaactagtggatcccccgggctgcaggaattcgcacgagaccattacctagaacatcctaatcgaaaagagtttcctattttcctctcctcccccacagcagctcggcgaaaaccctagtaagcaaaccaccgngagcagcggcgcnttgcgcgagcggagccatggcggacgacgattacaacgaaattgacatggggtatgaggatgagcccccagaaccggagattgaggaaggagctgaagaagagcctgagaacaatgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagttatggttgaacttgagggagaaactgaccctcttgagattgcaatgaaggagctgagagcgcgcaagatacccttcacgatcagacggtacttacctgatggaagctatgaagactggggagtagaccagctcattgtgaaggactccctgcaacgccaggttggtgggagactgaaaaagatcctcttggccatggaaagggtatgtgggtgcagtgggtgtttc

SEQ ID NO: 40518 - protein, 160 aa, Zea mays
  misc_feature: Ceres CLONE 1433311-F
  misc_feature (61)..(114): Pfam Name: RNA_pol_Rpb6 Pfam Description: RNA polymerase Rpb6
  misc_feature: SWISSPROT Homolog: EC 2.7.7.6 DNA-directed RNA polymerase
MADDDYNEIDMGYEDEPPEPEIEEGAEEEPENNEDAPDDVIGGEGEDKEQEKTKRERKTTKYMTKYERARILGTRALQISMNAPVMVELEGETDPLEIAMKELRARKIPFTIRRYLPDGSYEDWGVDQLIVKDSLQRQVGGRLKKILLAMERVCGCSGCF

SEQ ID NO: 40519 - DNA, 652 bp, Zea mays
  misc_feature: Ceres CLONE 1433314-F
  misc_feature: Encodes the peptide sequence at SEQ ID NO. 40520
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
gagctccccgcggtggcggccgctctagaactagtggatcccccgggctgcaggaattcgcacgagaccattacctagaacatcctaatcgaaaaacagaaatccagtcggcggggctgccgcctgccgcatcctcccctcgcccaccgtcgacgacttgatcccctcccaccgttgaggccgcctcctcacggcagcgagccagcgactcctctcttcttcgtctcctacaagtagccagacaccactccgactttgccggcaacccgtcgacagcgacgaggcgcagcataaggcatacgggcacggcggccatggcgaccagctccaaacccgccgcgcccgtggaccccatggtcgtgctcgcccacgagttccccgaggtgtcattcgactacgaccacccccatgtagcgtgtacgcctcgggttgtgctgcgcgagacgcgtcaccagaggagctccctcggtgccccggatgggcaccccccttaaacctcccctttttgttttttttcccaaaaaaaaaaggggggggttttaggccgccccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 40520 - protein, 59 aa, Zea mays
  misc_feature: Ceres CLONE 1433314-F
MATSSKPAAPVDPMVVLAHEFPEVSFDYDHPHVACTPRVVLRETRHQRSSLGAPDGHPP

SEQ ID NO: 40521 - DNA, 718 bp, Zea mays
  misc_feature: Ceres CLONE 1433317-F
  misc_feature: Encodes the peptide sequence at SEQ ID NO. 40522
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaacccgccccggctcagcctcatccccagccacacccatgcccgtgccaacagccgcatccaagcccgtgccagctgcagggaacctgcggcggtggcagcaccccgatctgggccagtgcgtcgagtttctgaggcatcaatgcagcccgacgggnaaccccctactgctcgcctcaatgccaagtcctttccgcaacacatgtttcccagcacctcaagcaaggggggagcccccacacccggtacaagggaaattttcggggtgggcccccccagcccacc

SEQ ID NO: 40522 - protein, 131 aa, Zea mays
  misc_feature: Ceres CLONE 1433317-F
MRVLLVALALLALAASATSTHTSGGCGCQPPPPVHLPPPVHLPPPVHLPPPVHLPPPVHLPPPVHLPPPVHVPPPVHLPPPPCHYPTQPAPAQPHPQPHPCPCQQPHPSPCQLQGTCGGGSTPIWASASSF

SEQ ID NO: 40523 - DNA, 666 bp, Zea mays
  misc_feature: Ceres CLONE 1433328-F
  misc_feature: Encodes the peptide sequence at SEQ ID NO. 40524
  misc_feature (332)..(332): n is a, c, t, g, unknown, or other
  misc_feature (397)..(397): n is a, c, t, g, unknown, or other
  misc_feature (443)..(443): n is a, c, t, g, unknown, or other
  misc_feature (498)..(498): n is a, c, t, g, unknown, or other
  misc_feature (499)..(499): n is a, c, t, g, unknown, or other
ggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctngcggtggtgcaagcaggcgtgcgagtggcagtacggaaaggacacgccgcggaagagggaatgcnagagcgagtgcccaagcgcaccagcaagctgacgcgggcgaagacngcaacagcggcgtgaacgcctacgtctcccgctccgggaggggcgagtgccggcnnccagtgcctgcgccgccacgaggggccagccgtgggagaaccaggattgcatgaagcggggccggccgccccggactggccgttcaattggaacaaaaagtaccgttcccggcaacaagaaccccgggcaaatccccgggaaagggtccaacccccccccccgcggg

SEQ ID NO: 40524 - protein, 83 aa, Zea mays
  misc_feature: Ceres CLONE 1433328-F
  misc_feature (64)..(64): Xaa is any aa, unknown, or other
MGKGSVGASWWAFLLLAGVLLVVAATAGAEDGVVERDRKEDLAVVQAGVRVAVRKGHAAEEGMXERVPKRTSKLTRAKTATAA

SEQ ID NO: 40525 - DNA, 711 bp, Zea mays
  misc_feature: Ceres CLONE 1433329-F
  misc_feature: Encodes the peptide sequence at SEQ ID NO. 40526
  misc_feature (648)..(648): n is a, c, t, g, unknown, or other
  misc_feature (688)..(688): n is a, c, t, g, unknown, or other
  misc_feature (689)..(689): n is a, c, t, g, unknown, or other
  misc_feature (704)..(704): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggtcggaggcaccgcgctcgcaagggctagccaacgagacagcagcaatggcggaccgtgaccgcagcggcatctacggcggcgcccacgccacctacgggcagcagcatcagcagggaagaggcgggcgccctatgggtgaacacgtgaagggcatgctccacgacaaggggccgaccgcgtcgcaggcgctgacagtggcgacgctgttcccactgggcgggctgctgcaagtgctatctgggctggcgctgaccggctccatggtggggctggacctggcaacccggtggtcctgatctttagcccccgtgcttgttcccccccgcgctactcattcggacagccctacatgggggttcctcacctccgggccccctatggggcccggggccttcccatactacgtgcctcttcaaacggggacggaagtgtttcaacccacccccccattaacttggaagagggcccccgcacgaatggcggaggtncccgccccccctcggccacaaaacccccacagtttgggcnnccaccctccaagcangcagtgg

SEQ ID NO: 40526 - protein, 83 aa, Zea mays
  misc_feature: Ceres CLONE 1433329-F
MADRDRSGIYGGAHATYGQQHQQGRGGRPMGEHVKGMLHDKGPTASQALTVATLFPLGGLLQVLSGLALTGSMVGLDLATRWS

SEQ ID NO: 40527 - DNA, 653 bp, Zea mays
  misc_feature: Ceres CLONE 1433331-F
  misc_feature: Encodes the peptide sequence at SEQ ID NO. 40528
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (225)..(225): n is a, c, t, g, unknown, or other
  misc_feature (226)..(226): n is a, c, t, g, unknown, or other
  misc_feature (231)..(231): n is a, c, t, g, unknown, or other
  misc_feature (234)..(234): n is a, c, t, g, unknown, or other
  misc_feature (235)..(235): n is a, c, t, g, unknown, or other
  misc_feature (237)..(237): n is a, c, t, g, unknown, or other
  misc_feature (263)..(263): n is a, c, t, g, unknown, or other
  misc_feature (332)..(332): n is a, c, t, g, unknown, or other
  misc_feature (451)..(451): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (570)..(570): n is a, c, t, g, unknown, or other
  misc_feature (576)..(576): n is a, c, t, g, unknown, or other
aaagctggagctccccgcggtggcggccgctctagaactagtggatcccccgggctgcaggaattcgcacgagaccattacctagaacatcctaatcgaaaagtcaatgcaagtttgtccattcgcattggtctgaatactgtagctactagcgcgagtgccactgtgccgcagctgcctgctcgccattactgcaagctgtgttcaatcaaagctnnntaattnnagggnccnntnccccctccctacatctggatccaggnctaaagtaagctagccagcactacaggaagggcgtggggcaggaattcagggaaaaaaatacccggggnggggggggccctaaaacccttaagccctagaaaaaactctccccgcgggggggggagaaacaaaaaaaaaaaaaataaagggcgccccccccggagaaaatttttgtgggcggcggggnaaaaaaaaaaaaattggggtggtggggggcggcgccccccccccccccgcggggggggggggnnncaaccccccccccttgggagggggnnnnnnaaaaaaaaaaaaaaaacccccccncccccngggggggttttttctcccggggggggggggggggggggggaaggaccctctataaacaaaacccccttttttttttt

SEQ ID NO: 40528 - protein, 72 aa, Zea mays
  misc_feature: Ceres CLONE 1433331-F
KAGAPRGGGRSRTSGSPGLQEFARDHYLEHPNRKVNASLSIRIGLNTVATSASATVPQLPARHYCKLCSIKA

SEQ ID NO: 40529 - DNA, 699 bp, Zea mays
  misc_feature: Ceres CLONE 1433340-F
  misc_feature: Translation starting site: 195
agagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaggcgcagtgcccgatcgtcgagcgcctcacaaactccctcatgatgcacgggcgccacaacggcaaagaggtcatggctgtccgcatcatcaagcataaccctggaaatcattcacctggtccccgaattgcaaccccatccagggtcgtcttcaaccccattaatcacaggggacccccgggggggagccccccccatttggttcccccctggtttttaaagaagggagccccgtaaattcccccccccctgagaggaggggaaaaaaggggtttttttcccctccaccccggggggcccgggggaaaagttttttccgaaaaaaaaaaaaa

SEQ ID NO: 40530 - DNA, 687 bp, Zea mays
  misc_feature: Ceres CLONE 1433342-F
  misc_feature (445)..(445): n is a, c, t, g, unknown, or other
tggagctccccgcggtggcggccgctctagaactagtggatcccccgggctgcaggaattcgcacgagaccattacctagaacatcctaatcgaaaaaataaaagtgaaattccattaccttgctgtctcggtctgtcggccatcgccggttgcgcagcgggcagcggctcacgtcgacggggaagactccggaggccacgggcgttacattctcctgccgtatttttgcgggattgaagtgacagccagggatccactcatcccctgggtggaaaaattcaggttgtggattggattgctagctaccgaacaagccctcagcgtgctaatttcagtggaatcttggtagacaccactgaacttcttggttccgagtgaagtcgagcatagagatcgtcttctctcacactgagttgcccagttattcccgaggtccttcaagcntagttctgatgatggctaagggccatggagcagtccatgcattcacgaaggaccccttggtttcttttggggccaaagctgatggttcaagatggcttaatttccccaaaggtccctcattcctcggggtcccaagaatctacccgcgataaattccctgccctccaaagggccctcaaaggggggaaccaacaagggaaccccaggttcccaacccaatttggggacctttttgaggggcc

SEQ ID NO: 40531 - DNA, 668 bp, Zea mays
  misc_feature: Ceres CLONE 1433344-F
  misc_feature: Encodes the peptide sequence at SEQ ID NO. 40532
gagctggagctccccgcggtggcggccgctctataactagtggatcccccgggctgcaggatattcgcacgagaccattacctagaacatcctaatcgaaaaaccgcgtctctcgctcactgactgagtactgtctataccctacatctaacatcttgctcctgcggctcatgaagacagttttgtgcatatgggggctgggggcaagaaagacagagagagtcatggtggcggaccagcagccgtccctgcacgacgagatgaacgacgctgccggctgcggcctcaggctgcctccagggttccgcttccactcgatcgacttcaagattgtcagcttctacctcaccaacgaggtgctcaacacgcgcttcagctgcaccgccatcgcggacgcccacctatacaagatcgacccatggaacctccccagcaaggcaaagatgggcgagaaatagtggtacttcttctaccagaacgaccgcaagtacccgacagtgctaagagcgaaccgggccaccaatgccggttactggaaggtgactggcactgacaaggaggtctactacgcctcggaatgagtggcgacactggaccgcatgaataaaacgctcttcttctacgggggcatggactcccaggggctgacaataccaactgggtcatgc

SEQ ID NO: 40532 - protein, 77 aa, Zea mays
  misc_feature: Ceres CLONE 1433344-F
MVADQQPSLHDEMNDAAGCGLRLPPGFRFHSIDFKIVSFYLTNEVLNTRFSCTAIADAHLYKIDPWNLPSKAKMGEK

SEQ ID NO: 40533 - DNA, 620 bp, Zea mays
  misc_feature: Ceres CLONE 1433354-F
  misc_feature: Translation starting site: 209
  misc_feature: SWISSPROT Homolog: EC 5.3.3.2 Isopentenyl-diphosphate Delta-isomerase
agagctggagctccccgcggtggcggccgctctagaactagtggatcccccgggctgcaggaattcgcacgagaccattacctagaacatcctaatcgaaaatgcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatggttgtggccatgagtcaaagtacaactgccatttgatggaaaagatgattctgagaatctgctacatagggcattcagtgtgttcccttttcaactcaaattatgagctgctacttcagcaaaggtcccgcggacaaggttacctttccctttagtttggaacaattcctggctggaccccccctttggaccgggggggcttgagcttttccgggaaaacctcccttggggtggaaaaattcgcccacaaggaaactcctcgggagagctggggattccccaccaaaaaaagcccccgtttgaccaatttccccc

SEQ ID NO: 40534 - DNA, 716 bp, Zea mays
  misc_feature: Ceres CLONE 1433355-F
  misc_feature: Encodes the peptide sequence at SEQ ID NO. 40535
  misc_feature (344)..(344): n is a, c, t, g, unknown, or other
  misc_feature (504)..(504): n is a, c, t, g, unknown, or other
  misc_feature (524)..(524): n is a, c, t, g, unknown, or other
  misc_feature (592)..(592): n is a, c, t, g, unknown, or other
  misc_feature (618)..(618): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtnggcggcgccgtcgtcgtcccgacggcgcggatggggccggagggtcgtccttcccccgtgttcgggggaggaggccgggtgggtggtgtaccagaagcagcgcccacccctctgcccagcggcatccccggcctacaccgtgcagattcatcaacgtctngcggcggaagggtgcacccntgtacgacgtggcacgtctcccctgcgcgacttcgcctcccacggagctcgtcgacccggccagtttncaagcgcgtcggcttccgagaaatgnannnnngctctaaggcggcccacgctgaccacgagacgtctcttcagtactcactcttctctaacagtcagtgtcgcttcgtcgctggcactaagatc

SEQ ID NO: 40535 - protein, 145 aa, Zea mays
  misc_feature: Ceres CLONE 1433355-F
  misc_feature (51)..(51): Xaa is any aa, unknown, or other
  misc_feature (104)..(104): Xaa is any aa, unknown, or other
  misc_feature (111)..(111): Xaa is any aa, unknown, or other
  misc_feature (133)..(133): Xaa is any aa, unknown, or other
  misc_feature (142)..(142): Xaa is any aa, unknown, or other
  misc_feature (143)..(143): Xaa is any aa, unknown, or other
  misc_feature (144)..(144): Xaa is any aa, unknown, or other
MGEWCFKKRAALVIIVAIISSLQLLLITAQEAGGDHEVWSSSSSPAGGRGXRRRRRPDGADGAGGSSFPRVRGRRPGGWCTRSSAHPSAQRHPRPTPCRFINVXRRKGAPXYDVARLPCATSPPTELVDPASXQARRLPRNXXXL

SEQ ID NO: 40536 - DNA, 537 bp, Zea mays
  misc_feature: Ceres CLONE 1433363-F
  misc_feature (179)..(179): n is a, c, t, g, unknown, or other
  misc_feature (239)..(239): n is a, c, t, g, unknown, or other
  misc_feature (474)..(474): n is a, c, t, g, unknown, or other
  misc_feature (475)..(475): n is a, c, t, g, unknown, or other
ggagctccccgcggtggcggccgctctagaactagtggatcccccgggctgcaggaattcgcacgagaccattacctagaacatcctaatcgaaaagcactcaagccctgcccatcagcacaaccaccaccaccaccgcctggccgtaacgtcacacgctcgcctcttccatggcgccnagaacgctctccccgccgcagcgccgtggccaacggcatggtgatggagccgaaggtccngcgccgtcgggaaccgcccgtgggggcaagttccccgcccgaaaattccgggaccccgcccaagaaagggccccccttttggggttttggaacccttttaaaacccgccaaggggcggggggggggggcccttaaaaaaccccgccccggcttcccatttttcgggggggggcccaagggggggccaaaaaaaaaaaaaaaattttttccccccccccgggggtgtgtttttttnngggggggtttttttttttttttttccccccccccccccccccccccccaaaaaaaaaaaaag

SEQ ID NO: 40537 - DNA, 652 bp, Zea mays
  misc_feature: Ceres CLONE 1433371-F
  misc_feature: Translation starting site: 220
  misc_feature: SWISSPROT Homolog: EC 1.1.1.8 Glycerol-3-phosphate dehydrogenase (NAD(+))
  misc_feature (215)..(215): n is a, c, t, g, unknown, or other
  misc_feature (435)..(435): n is a, c, t, g, unknown, or other
  misc_feature (448)..(448): n is a, c, t, g, unknown, or other
  misc_feature (477)..(477): n is a, c, t, g, unknown, or other
gctccccgcggtggcggccgctctagaactagtggatcccccgggctgcaggaattcgcacgagaccattacctagaacatcctaatcgaaaaaatttcactttccttctctcctctcctcctgctgctactaggttcgggccgtccgtccttgctcttgatctgcattatttaattcggaccattcccccgccgtcctcccgcccgcctgccgngaagatggagatggagaacgggcacgccaagtaccgggtggccgtcattggcagcggcaactggggcagcgtcgcctcccgcctcatcgcctccaacaccgccaagctgccctccttctatgatgaagtaagggatgtggtgtttgaggaatactgcctacaggcaggaagctatctgagtcccttaacgaacagaatgagaactgcaaatacttgccangtataaagcttgnaacgaaatgtattgccgaccctgacttgnagagcgcagtcaaagacgcgaatatgctggttttttgtgacgccccatcaatttgtggaaggtatatgtaaagaagcttgtagggaagctacaccagggagctgaggctatctccctcatccaggggcatggaagtcaagatggaaggggcctgcatgaaattccaagttaatcc

SEQ ID NO: 40538 - DNA, 693 bp, Zea mays
  misc_feature: Ceres CLONE 1433372-F
  misc_feature: Translation starting site: 190
  misc_feature (378)..(378): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaaaaaccttagccgcgcggacgcccaccagcagctgcccccttgctgtcgccgcctctccgcgcgaccgatctaccgccgccgccaccatgtcgctgatcgccggcgaggacttccaacatattctgcgtctgctgaacaccgacgtggatgggaagcagaagatcatgttcgccatgacctccataaagggtgttgggcgccacttctccaacatcgtctgcaagaaggccgacatcgacatgaacaagagggccggtgagctgacgcttgaaaancaggagcgcctgatgacgggcgtggcgaaccctatgcagttcaaggtgccggactggttcctcaacaggaagaatgattacaagggacggaaggttctcacaggtcgtctccaacgccctcaacatgaagctcagggactacctccnagaggctccagaagatcaggaaccaccgtggttctgcctcactactgggggcctccgtgtaccgtggtccacaacaccaaggaccacctgggcagggccgcaaaaaactgtttggtggctcccataaaccaataaagctaccatattctattcgaaaaaatctccaga

SEQ ID NO: 40539 - DNA, 716 bp, Zea mays
  misc_feature: Ceres CLONE 1433375-F
  misc_feature: Encodes the peptide sequence at SEQ ID NO. 40540
ccccgcggtggcggccgctctagaactagtggatcccccgggctgcaggaattcgcacgagaccattacctagaacatcctaatcgaaaaaccaccaaaccaatcgctggatttgtccagagtatttccggtttcaccgccctagatctgacccgagacgccgcgtcttcgctgagatggcgattactgtgaggcggtcgacgatggtgcgcccggcgcgggagacgccgcggcagcggctgtggaactccaacctcgacctcgtggtgccgcgcttccacacgcccagtgtctacttctaccgccgcgacggccccctggccggatccggaggggttcttccaccgtcaagcggatggcggccccgcgcttgtaagaagggcctcctgcccgtttcttccccattggggggggccccccccccccccgcgcccaaagcaccgggaagggtttcgaaaaattaaacttccccacggccccagggggaggggtttttttttttttaaggtcccaactccccccccaaaacccccccctttctatagaaatcacggagtggactttccgccccccccccctgtgggaccccaaagagggcttctttttccccaaaaccggggtttttttctctcctcgaaaagaacacccccgggggcctttttcctcccccatccctgtgcgcccccgggggggggttttttattttctaaaagggg

SEQ ID NO: 40540 - protein, 95 aa, Zea mays
  misc_feature: Ceres CLONE 1433375-F
  misc_feature: SWISSPROT Homolog: EC 2.3.1.144 Anthranilate N-benzoyltransferase
MAITVRRSTMVRPARETPRQRLWNSNLDLVVPRFHTPSVYFYRRDGPLAGSGGVLPPSSGWRPRACKKGLLPVSSPLGGAPPPPAPKAPGRVSKN

SEQ ID NO: 40541 - DNA, 706 bp, Zea mays
  misc_feature: Ceres CLONE 1433394-F
  misc_feature: Encodes the peptide sequence at SEQ ID NO. 40542
aagctggagctccccgcggtggcggccgctctagaactagtggatcccccgggctgcaggaattcgcacgagaccattacctagaacatcctaatccaaaaacggatccaccggagagatctggtctgccattcccacgctccttcctgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggctaagcatcccaagacagacgtgtaccagtggttcccccatctgaagaagtgaaaggcctgaacttagcaaccagcgctgggtttggtcactacgatcgggccagggggcgttccttgtgttgagggtgttcattccgtgttattctcccgtcagtcatgcgtcctgtcctatgttaacctacataagaagtgatgggggggccaacttttagtgaaactaacggcctgctgttaaaacttgggtgggcctcaaaacaatgattttctggtggaaaaagaattacta

SEQ ID NO: 40542 - protein, 77 aa, Zea mays
  misc_feature: Ceres CLONE 1433394-F
  misc_feature (4)..(73): Pfam Name: DUF1909 Pfam Description: Domain of unknown function (DUF1909)
MGGGNGQKSKMARERNLEKNKGAKGSQLETNKKAMSIQCKVCMQTFMCTTTEVKCREHAEAKHPKTDVYQWFPHLKK

SEQ ID NO: 40543 - DNA, 722 bp, Zea mays
  misc_feature: Ceres CLONE 1433398-F
  misc_feature: Encodes the peptide sequence at SEQ ID NO. 40544
  misc_feature (427)..(427): n is a, c, t, g, unknown, or other
aagctggagctccccgcggtggcggccgctctagaactagtggatcccccgggctgcaggaattcgcacgagaccattacctagaacatcctaatcgaaaaagacgcaccccttcctcgtttcgccgcctccgccgacaccgactgcctccctcagctgccgtcgccatgggcagaaggcctgctagatgctatcgccagatcaagaacaagccataccctaagtccaggtactgccgtggtgtccctgacccgaagatcaggatatacgatgtcgggatgaagaggaagggtgttgatgagttcccctactgtgtgcaccttgtctcttgggagaaggagaatgtctccagtgaggcgcttgaggctgcccgcattgcctgcaaacagtacatgaccaagtctgcaggaaaggatgccctccaccntagggtccgggttcaccccgttcaatgtccttccgtatccaccaagatgcttttcgtgtgcctggggctgaatagcctcagactggaatggagggtgcctttggcaaagcctcagggcccctgttgctagggggaaatttggccaagtcctccttttccgggggaatgcaggaaaaacatggctgcccaatgcaagaaaatctttggggccccccaaagttacaaattcccgggccccccaaaaaattctttgaaaacacaaaaggggggctttcccccaatttccccccccccc

SEQ ID NO: 40544 - protein, 129 aa, Zea mays
  misc_feature: Ceres CLONE 1433398-F
  misc_feature (5)..(121): Pfam Name: Ribosomal_L16 Pfam Description: Ribosomal protein L16
  misc_feature (87)..(87): Xaa is any aa, unknown, or other
MGRRPARCYRQIKNKPYPKSRYCRGVPDPKIRIYDVGMKRKGVDEFPYCVHLVSWEKENVSSEALEAARIACKQYMTKSAGKDALHXRVRVHPVQCPSVSTKMLFVCLGLNSLRLEWRVPLAKPQGPCC

SEQ ID NO: 40545 - DNA, 671 bp, Zea mays
  misc_feature: Ceres CLONE 1433401-F
  misc_feature: Encodes the peptide sequence at SEQ ID NO. 40546
tggagctccccgcggtggcggccgctctagaactagtggatcccccgggctgcaggaattcgcacgagaccattacctagaacatcctaatcgaaaaacgtcgaccagtacgtcgaaaaggaacacgtcgcccccatttcccacccgctttctccccctttggcctccccccctctctctctctcatctcctgccgataagaagcttcgccgccgtctcctctttctccgtcctagcaaaatcctccccgtattgagagccaaagaagaaaaaaaaacaaaggcaggaggccggcgaactacgcgaggaaaaattttctttcccgggaggctcgggagtcggacacgccacacgctttggtcaaaatcgtttccggttgttagcgcggctgctgctgccgctgctgtcgggggcgagcaggaaggggagcgaacgagcttgggcagctcaagaaagaggggacgggggagggagcctgtggaaggcacctgagtacgcgtgaaggagcccgcgcgagagtaggggggaaaccaaatcgagagacatggactcggagcactggatctcgcgcctggccgccgcaaagcgttactacgcggcgcagctcggccgcgtcgacgatgtgcccgggatggggacggaagaggtggagatggaggtggaggacgacg

SEQ ID NO: 40546 - protein, 42 aa, Zea mays
  misc_feature: Ceres CLONE 1433401-F
MDSEHWISRLAAAKRYYAAQLGRVDDVPGMGTEEVEMEVEDD

SEQ ID NO: 40547 - DNA, 726 bp, Zea mays
  misc_feature: Ceres CLONE 1433415-F
  misc_feature: Translation starting site: 205
  misc_feature (334)..(334): n is a, c, t, g, unknown, or other
  misc_feature (340)..(340): n is a, c, t, g, unknown, or other
  misc_feature (343)..(343): n is a, c, t, g, unknown, or other
  misc_feature (352)..(352): n is a, c, t, g, unknown, or other
  misc_feature (412)..(412): n is a, c, t, g, unknown, or other
  misc_feature (457)..(457): n is a, c, t, g, unknown, or other
  misc_feature (606)..(606): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgagggcatgctccacgacaggggccgacngcgtcncangcgctgacngtggcgacgctgttcccgctggggcggctgctgctggtgctgtcggggctggcgctgacngcctcccgtggtgggctggccgtggccacgccggtgttcctgatnctcagccccgtgctggtccccgccgcgctgctcatcgggacggccgtcatggggttcctcacgtcgggcgcgctggggctcgggggcctgtcctcgctcacgtgcctcgccaacacgcgcggcaagcgttccagcgcaccccgactacngtgaagaggcgcacgcaggaatgcggaagccgcgcccacccggccaacagaccgcgcaggcagggccagccatccaggcagggcccaagaagccgcccccggggaagtgcaggtgcccgc

SEQ ID NO: 40548 - DNA, 661 bp, Zea mays
  misc_feature: Ceres CLONE 1433417-F
aaagctggagctccccgcggtggcggccgctctagaactagtggatcccccgggctgcaggaattcgcacgagaccattacctagaacatcctaatcgaaaaagatggctgagagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagtggcccagctccaagcctccagccatcggcgcccgccctcctccgccgagacgccgagtgccgagcgcccgagcaccccggtccccagcgcccaacaagctagcaggctgcaggtatgcgctctttgttgatgcgtccaaggagttgagctgaatgcccagaaggctagcaggctgcagaaactgaaggaaaaggcggcattcaggaacccggatgagttctattttaaaatgatcaacagtaggactgttggtggaattcaaagacctaagcctgaagataataagtatactgaa

SEQ ID NO: 40549 - DNA, 710 bp, Zea mays
  misc_feature: Ceres CLONE 1433420-F
  misc_feature: Encodes the peptide sequence at SEQ ID NO. 40550
  misc_feature (436)..(436): n is a, c, t, g, unknown, or other
  misc_feature (497)..(497): n is a, c, t, g, unknown, or other
  misc_feature (532)..(532): n is a, c, t, g, unknown, or other
  misc_feature (562)..(562): n is a, c, t, g, unknown, or other
  misc_feature (563)..(563): n is a, c, t, g, unknown, or other
  misc_feature (573)..(573): n is a, c, t, g, unknown, or other
  misc_feature (593)..(593): n is a, c, t, g, unknown, or other
  misc_feature (640)..(640): n is a, c, t, g, unknown, or other
  misc_feature (658)..(658): n is a, c, t, g, unknown, or other
  misc_feature (678)..(678): n is a, c, t, g, unknown, or other
  misc_feature (701)..(701): n is a, c, t, g, unknown, or other
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaaaccgtagcacacaccagtacaccacacactcgcctttccgatcccatccctctccagccaccttcctccgctcgccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcgcgcggggtttccgatcggggtcatgggcggtttctgtgtttctgccgcgcgacttggcttgcctgatngtggcctcatttcctatggagaaatggtagatcaagggcgtctcatcaatgaagctgtttncatcccagtgattggtgatggagacaatggttacngaaactctatgaaatatcagagaaccatannaggatatatncatgctgggtttgctggaanttatgctgaggatcaggtggcaccctaaagcatgtgacatactgaanggaagaaagtcatatcanggggagaagctgtcatgcancataaagctgctgtagatgctanngaagagag

SEQ ID NO: 40550 - protein, 136 aa, Zea mays
  misc_feature: Ceres CLONE 1433420-F
  misc_feature: SWISSPROT Homolog: EC 2.7.8.23 Carboxyvinyl-carboxyphosphonate phosphorylmutase
  misc_feature (76)..(76): Xaa is any aa, unknown, or other
  misc_feature (96)..(96): Xaa is any aa, unknown, or other
  misc_feature (108)..(108): Xaa is any aa, unknown, or other
  misc_feature (118)..(118): Xaa is any aa, unknown, or other
  misc_feature (121)..(121): Xaa is any aa, unknown, or other
  misc_feature (128)..(128): Xaa is any aa, unknown, or other
MAARCPYFAVEESSRGIRSGESPAAALRRILATPGAHQAPCCYDALGARLVERAGFPIGVMGGFCVSAARLGLPDXGLISYGEMVDQGRLINEAVXIPVIGDGDNGYXNSMKYQRTIXGYXHAGFAGXYAEDQVAP

SEQ ID NO: 40551 - DNA, 657 bp, Zea mays
  misc_feature: Ceres CLONE 1433421-F
  misc_feature (424)..(424): n is a, c, t, g, unknown, or other
ggagctccccgcggtggcggccgctctagaactagtggatcccccgggctgcaggaattcgcacgagaccattacctagaacatcctaatcaaaaaatctgccatcttcgtctatccctttcatctcagttttgcagtttctactgctgtcttcgctccgaaatccaaccgaaatctcagaggaaagtaggaaacctcgttcgggaacctgctttgagtgagactccaatccttgggcgccattgccgcctgttttttgtgctcggaaaggcgctgtctgattcctgtatattattttggcatgctttcagctgcacaaactaaccatggatgcactagctttgactgacagagcacgaaggtcaatttgtctcctttctactcaactttttatgagtgggagatcgcagacaggggcttgttncacatgacatcagtcctgtgaacaaggtgctacctggagtactattttgtggcacattaattgaggacgtgaccaaagaagcggcaactgagttcacattgaccaggtctccagcattttgttatgagaagtcatttcccaaagtcaccccgtgggagggatctttaattcatgacccggaaaagatccgccaaaatttggagggggtcccgaaacggttcaactcttctagg

SEQ ID NO: 40552 - DNA, 658 bp, Zea mays
  misc_feature: Ceres CLONE 1433424-F
  misc_feature: Encodes the peptide sequence at SEQ ID NO. 40553
tggagctccccgcggtggcggccgctctagaactagtggatcccccgggctgcaggaattcgcacgagaccattacctagaacatcctaatcgaaaaattatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtactttgtgatggcaaggtcagggacagacaagacctacccctgctggggtccatgggatggtcattttcccaccccccagaccaatgaaaaatacgggggtgttgtaaaaaaacaaagggggcgtttccgcttttccccaattgggggaggagggagctaaattccaaccttttccaaggggaagggcctttccattttgggccaaaaggggtctcccttttttttaaaacccctttgaacggcccccccccccccccccc

SEQ ID NO: 40553 - protein, 98 aa, Zea mays
  misc_feature: Ceres CLONE 1433424-F
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALTYREVISILMQRHVLCDGKVRDRQDLPLLGSMGWSFSHPPDQ

SEQ ID NO: 40554 - DNA, 676 bp, Zea mays
  misc_feature: Ceres CLONE 1433429-F
  misc_feature: Encodes the peptide sequence at SEQ ID NO. 40555
ctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaacaagtagctctggcaaacctttctccctactctcagcaacacaatttctttcattcaacaactgtctacactgaaccctgcttgctatttgcagcaacactataaccatttacccagctagctactgtctactctcagcaaaacaacttcttcaatttaaccaattggcgcactgaacccggctgcttattgcagcaacaataat

SEQ ID NO: 40555 - protein, 105 aa, Zea mays
  misc_feature: Ceres CLONE 1433429-F
MATKIFSLLMLLALSTCVANATIFPQCSQAPIASLLPPYLPSIIASICENPALQPYRLQQAIAASNIPLSPLLFQQSPALSLVQSLVQTIRAQQLQQLVLPLINK

SEQ ID NO: 40556 - DNA, 546 bp, Zea mays
  misc_feature: Ceres CLONE 1433435-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (287)..(287): n is a, c, t, g, unknown, or other
  misc_feature (288)..(288): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactccccgcggtggcggccgctctagaactagtggatcccccgggctgcaggaattcgcacgagaccattacctagaacatcctaatcgaaaaaaaaagggtaccggaagcggcgaaagcctcgccccccgccgctctcgcatcgtctccggagcgcacgtcagaatcaggtgcgccgcgcccccccctcgnnctaggctgcgacgaccatccatcgaaacaggaaggatgaccgggcttccatgggatcctcccccggcccaaaggggcgggggtttccacgcttttccaaacccctgttgtcccccccccgggaaaaaaaaaaatattttttggaaaaaaaaaaaaaggggggtttaaaggggcccccgggggttttttcggaaaaaaaaacgggggaaaaaaaacctttttttgggggggccttcttttttttttgaaaagggggggg

SEQ ID NO: 40557 - DNA, 724 bp, Zea mays
  misc_feature: Ceres CLONE 1433440-F
  misc_feature (272)..(272): n is a, c, t, g, unknown, or other
  misc_feature (311)..(311): n is a, c, t, g, unknown, or other
  misc_feature (312)..(312): n is a, c, t, g, unknown, or other
gggagctccaccgcggtggcggccgctctagaactagtggatcccccgggctgcaggaattcgcacgagaccattacctagaacatcctaatcgaaaaaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaagaaaatggttgagttcatggnagaaggtagcgaaaactgttgacttcgaagagctcactnngtgagaggcgcacctccctgtctgtgcatacagaacgtcattggagcccgccgtgctcatgcgcatctctccttcctcaagcaaggaggaggtcaaggaatgaggacctgataacctctccaggaaatccgggcaaaatggacctgaacctccccaagttgggaaggggcccccaaaattttccaaattccccttggggcctttcccccccccccaaagcaagggttttttttttaaaaagaggggggcaccaacaaaaccttttgggttttcaaaagggggcaaaaaaaaaacccctttttaaaaaaccgggggggaaaaaaggcccccaaaaaatttttgggggggcaccccccccccccccctaagggggggggggggccccccccccgggggggaaaaaaaaaaacca

SEQ ID NO: 40558 - DNA, 645 bp, Zea mays
  misc_feature: Ceres CLONE 1433441-F
  misc_feature: Encodes the peptide sequence at SEQ ID NO. 40559
  misc_feature (423)..(423): n is a, c, t, g, unknown, or other
  misc_feature (576)..(576): n is a, c, t, g, unknown, or other
aaagctggagctccccgcggtggcggccgctctagaactagtggatcccccgggctgcaggaattcgcacgagaccattacctagaacatcctaatcgaaaagtcacccacgagcccaacaaaccactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcangaggtggtgtcccggatcccgctcaccacggccgatgagttcaaagctgccgtcgatgccgccaggacggccttccccggctggcggaacacgcccgtcacgacgcggcagcgcgtcatgttcaagtccaggagctcatcggggctacatggnacagcttgcagagacatcactacggagcaggggagacgctaaaaatgcttggggcgacttgtccgcggc

SEQ ID NO: 40559 - protein, 133 aa, Zea mays
  misc_feature: Ceres CLONE 1433441-F
  misc_feature: SWISSPROT Homolog: EC 1.2.1.27 Methylmalonate-semialdehyde dehydrogenase (acylating)
  misc_feature (69)..(69): Xaa is any aa, unknown, or other
MLRSALFRSAPGLRRSPATAHLSTAAAAAAAWLSNGPASAPSRVRLLIGGEFVESRADEHVDVTNPATXEVVSRIPLTTADEFKAAVDAARTAFPGWRNTPVTTRQRVMFKSRSSSGLHGTACRDITTEQGRR

SEQ ID NO: 40560 - DNA, 691 bp, Zea mays
  misc_feature: Ceres CLONE 1433444-F
ctccccgcggtggcggccgctctagaactagtggatcccccgggctgcaggaattcgcacgagaccattacctagaacatcctaatcgaaaaagaaattcgtaactagagaaccgtaactccggtttgatccattcgaattgcgttggattcataataatatcgtctgtacagtatgacactaacatatatcacaccccatacttttattattagaaatttgtctagcctatgtttaatagattaacccctctaattgaagttaacctctccataattatagtttgattaaaatatgatttctagttaagttataattaagattaaagttgaattaattattaatggaatattctctcatatggtgcatactaatcaatttataatatagtttaatcacatagatcttccataaatcataactccttaaccatgactccgatcttactagttctcgaacccacgatctcgtagcgacgagtagatcattattatgcaatttgttcttatgtttggtgtgatgttaattattcctataccatgtttgtttgtattgctatgactagtagtgaggtcacgagaatctaaagatcatcttgatacctggaatctcaagtcccaagaaagttatgcccttgatcacttttatttacccaataatgttctttataatcatttactcctgcataggt

SEQ ID NO: 40561 - DNA, 711 bp, Zea mays
  misc_feature: Ceres CLONE 1433450-F
  misc_feature: Encodes the peptide sequence at SEQ ID NO. 40562
  misc_feature (711)..(711): n is a, c, t, g, unknown, or other
aagctggagctccccgcggtggcggccgctctagaactagtggatcccccgggctgcaggaattcgcacgagaccattacctagaacatcctaatcgaaaaacatccaagtcctttctccaccgaacctcatgaactagccgttgcccgcacctctccacgtcgcgcttcccatggactccgccaccgtggcgctcgccatccccgcctccgacgaccgacggttctgggaccgcctccgcacccgcgtcgacaccatcctcgaggaccgccgtggcctcccgccagccgccgccgccggtgcccccatgcgaggggtggaatctgagcgggggaaacggctccgggaagactccctgatgctcgtccgtggcctcaactctggggcggagtctctggcacagctctccgacaccctctccgccgcgcagaagggagtgagtgctctcgcgacctgctcttcgcacgcgaggggatgcgaaggcggcacctgcccctgccccgaggaggtgaaggcagacgaggaagaccccagggctaatcggatgtgtggctgctccacggaagattctccacggaacggcctggacagcaattctccggccgctggagaggaaacggcggctggtcctgatggtctggggaaggagaatgaccaggcctctgctgatatcgcacagagcactaacctgaagcgggacataagtctggn

SEQ ID NO: 40562 - protein, 179 aa, Zea mays
  misc_feature: Ceres CLONE 1433450-F
MDSATVALAIPASDDRRFWDRLRTRVDTILEDRRGLPPAAAAGAPMRGVESERGKRLREDSLMLVRGLNSGAESLAQLSDTLSAAQKGVSALATCSSHARGCEGGTCPCPEEVKADEEDPRANRMCGCSTEDSPRNGLDSNSPAAGEETAAGPDGLGKENDQASADIAQSTNLKRDISL

SEQ ID NO: 40563 - DNA, 742 bp, Zea mays
  misc_feature: Ceres CLONE 1433456-F
  misc_feature (652)..(652): n is a, c, t, g, unknown, or other
  misc_feature (676)..(676): n is a, c, t, g, unknown, or other
  misc_feature (695)..(695): n is a, c, t, g, unknown, or other
  misc_feature (696)..(696): n is a, c, t, g, unknown, or other
  misc_feature (722)..(722): n is a, c, t, g, unknown, or other
ccccgcggtggcggccgctctagaactagtggatcccccgggctgcaggaattcgcacgagaccattacctagaacatcctaatcgaaaagtctggccgtcttccagacgtctccaatcggagctcccagcgtctcggagaagaggagcagcacggcacggcagctgtggcgaggaaggctcttgtcctgtcccatcgcaacccagcaggcgtccatggaggaggagatccaatcggctgtgcatgcgatctaccgtcctgtcatgcgatccaaattcaaatctggcagtgagcagctcgatgcagattcccaaccaacagctcgaaatcgccggcttctcccatcctagtgaatgaaactatggccctcctgcgtcgcggcttcgttcctgaacgaaaaggttgctgtggaaaccctgcccccttttagcccctggccgaacttcccgggataaagggcccaccgcccccaaatggggttttttcccgggggggggggcctttaaaatttttacgagaactcccgcggggtttttaaaaatttacaagggaggtgttcttccgaagaacacaagggggggggggcggcttttttttttggggggggggggcggggcacaaaaaaaaaaggggtgggtgggttgaaaaaaantatttttttttatccccccccccntaaatatttttttttcccnntaaaaaaaaagggggggacgttgggnttcccacccccgcgccgggg

SEQ ID NO: 40564 - DNA, 674 bp, Zea mays
  misc_feature: Ceres CLONE 1433459-F
  misc_feature: Encodes the peptide sequence at SEQ ID NO. 40565
  misc_feature (570)..(570): n is a, c, t, g, unknown, or other
tccccgcggtggcggccgctctagaactagtggatcccccgggctgcaggaattcgcacgagaccatacctagaacatcctaatcgaaaaacaaaaaaattcggccgactcacgtgaggccacgacccgtcactacggccgaccccgactcggcggctgcaccgcaatccgaccgaccgccgtccgtccctctccacgccgtctgccgccgcatcaatccagcaggcagcgacctaggggctgtccgtgtccggttgggaggcgccgggcgcactggggtgggcggctgcccgcctggccggccagccgtaagcgccgagcggcgtgccggcatctccgttgcggtgtgggcaaggcaccagcggccagtgctgagcattgtgggcgcaactgttagagatccgactttattcctgaaggcatttgtctgaactttttcggaaatgagtgccggtggtgcttttggtggaaatagggggctgaggcctgtaccccctgaaaaaggtgtattcccattggaccacttacatgagtgcgacttggagaagaaagactatcttgcctgcctgnaatctacagggtttcaatctgaaaaatgccacagttctcaagaagtatctggaatgtcgaatggagagaaacttgatggcgaaccagacatgtcagagcttggg

SEQ ID NO: 40565 - protein, 77 aa, Zea mays
  misc_feature: Ceres CLONE 1433459-F
  misc_feature (43)..(43): Xaa is any aa, unknown, or other
MSAGGAFGGNRGLRPVPPEKGVFPLDHLHECDLEKKDYLACLXSTGFQSEKCHSSQEVSGMSNGEKLDGEPDMSELG

SEQ ID NO: 40566 - DNA, 700 bp, Zea mays
  misc_feature: Ceres CLONE 1433460-F
  misc_feature: Encodes the peptide sequence at SEQ ID NO. 40567
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcacgaggggccccgtggaggcgaagcaggcgctctactcgagggacctcgctcgcaacctgcgcttcgcctccaacttcgacctcttcaaggctgctgcggccgactggcgcgacacgctccttctgcgaggtggctccgaacccgccgccgcgggaggagctgccggagccactcangaacgtgatgctgga

SEQ ID NO: 40567 - protein, 185 aa, Zea mays
  misc_feature: Ceres CLONE 1433460-F
  misc_feature: SWISSPROT Homolog: EC 1.14.11.20 Desacetoxyvindoline 4-hydroxylase
  misc_feature (180)..(180): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFTRGPVEAKQALYSRDLARNLRFASNFDLFKAAAADWRDTLLLRGGSEPAAAGGAAGATXERDAG

SEQ ID NO: 40568 - DNA, 730 bp, Zea mays
  misc_feature: Ceres CLONE 1433462-F
  misc_feature: Encodes the peptide sequence at SEQ ID NO. 40569
  misc_feature (730)..(730): n is a, c, t, g, unknown, or other
aagctggagctccccgcggtggcggccgctctagaactagtggatcccccgggctgcaggaattcgcacgagaccattacctagaacatcctaatcgaaaaacactacccataagcagccacagctgcctccttcctcctctcactctcgctcgtgctgcgctcgctacctcgattagcattccaatcaacgagagcggtgagaggggaggaaaggcaagatgttcatcgagagcttccgcgtctagagcccccacgtgcggtacgagcccgactgacatggagtcatactaccggtacaacaccacggacctggcacacgagggcaaggacggcgcctcacgctgggtcgtccgccccgagtccgtcaagtacaacttcaggaccacaaccgccttccccaagctcagagtgatgcttgtggggtggagaggcaacaacagcgccacgctgacggctggcgtcattgccaacagggaggggatctcatgggcgacaaacgattatgtgcagaaagccaactactactgctccctcacccaggcctccatcatcatagtccgctgctacaacggggaggagatctatgcgtcgttcaacagcctccttctcatggtgaacccagacgacattgtgttcggaggctgggacattagaaacatgagactggccgacgtcatgactagcggcaaggtgctgcgaatagacctgcagaatcagctgacgccctn

SEQ ID NO: 40569 - protein, 150 aa, Zea mays
  misc_feature: Ceres CLONE 1433462-F
  misc_feature: SWISSPROT Homolog: EC 5.5.1.4 Inositol-3-phosphate synthase
MESYYRYNTTDLAHEGKDGASRWVVRPESVKYNFRTTTAFPKLRVMLVGWRGNNSATLTAGVIANREGISWATNDYVQKANYYCSLTQASIIIVRCYNGEEIYASFNSLLLMVNPDDIVFGGWDIRNMRLADVMTSGKVLRIDLQNQLTP

SEQ ID NO: 40570 - DNA, 672 bp, Zea mays
  misc_feature: Ceres CLONE 1433525-F
  misc_feature: Encodes the peptide sequence at SEQ ID NO. 40571
aagctggagctccccgcggtggcggccgctctagaactagtggatcccccgggctgcaggaattcgcacgagaccattacctagaacatcctaatcgaaaaacggtgttgactatctcgagtccgttgacattgacaagggggccaggtcgaggctttccgagctccgatccctctccaacgcctgagggatggccgtgccggcgcccgcgaaggcggcgcgcttgcttgcggcctccgcggcggtgctcgtgctgctgtggtgtgtccatttccgcggtgggctctccttcggctcccccaccaacaagggcctcatcttcaacgtgcatcctgtgcttatgctaataggattcatcatcctagggagcgaagccataatgagctacaaaatatggccatggagtcatgatacaaacaagatggttcacatgcttcttcatgctgttgcactcttcctgggttctgttgggatatatgctgccttcaagttccacaatgaaagtggaattgataatctgtacagcttgcattcgtgggttggacttggaactatctgcctgtacggtatacagtggctatttggcgttgctaccttcttcttccctggtgcttcgccaacagtccggcgcagaatgctcccatggcacactcgcgctggacttgttgtcta

SEQ ID NO: 40571 - protein, 160 aa, Zea mays
  misc_feature: Ceres CLONE 1433525-F
  misc_feature (7)..(160): Pfam Name: Cytochrom_B561 Pfam Description: Cytochrome b561
MAVPAPAKAARLLAASAAVLVLLWCVHFRGGLSFGSPTNKGLIFNVHPVLMLIGFIILGSEAIMSYKIWPWSHDTNKMVHMLLHAVALFLGSVGIYAAFKFHNESGIDNLYSLHSWVGLGTICLYGIQWLFGVATFFFPGASPTVRRRMLPWHTRAGLVV

SEQ ID NO: 40572 - DNA, 616 bp, Zea mays
  misc_feature: Ceres CLONE 1433541-F
  misc_feature: Encodes the peptide sequence at SEQ ID NO. 40573
ggagctccccgcggtggcggccgctctataactagtggatcccccgggctgcaggaattcgcacgagaccattacctagaacatcctaatcgaaaaaaacccaaactaacccttctaatccaaggctgtgaagggagctgctagccgccaccagccgccatgtctggagggatcgcgcgcggccgcctcgccgaggagcgcaaggcctggcgcaagaatcacccccacggtttcgtggcgaggccggagtcgctgaacgacgggtccgtgaacctcatggtctggaactgtaccatccccggcagccccggaaccgattgggaaggtgggtactacccacttaccccttcttttcggggaaaatacccccagccaacctccccaatggaagtttctcccgggtttttttccccccccaatgttttcccccaggggaaactgtctgccctcttttttttaaaaaagaataagctttgggaacccctttctccttttttaaacaaattttttttgggaaaaaaggaatttttttgttaacccccccccccctttttccccctccaagggggggtttttccccttttttcccggggggccgcgaaaaaaaacccccccc

SEQ ID NO: 40573 - protein, 125 aa, Zea mays
  misc_feature: Ceres CLONE 1433541-F
  misc_feature (9)..(126): Pfam Name: UQ_con Pfam Description: Ubiquitin-conjugating enzyme
  misc_feature: SWISSPROT Homolog: EC 6.3.2.19 Ubiquitin--protein ligase
MSGGIARGRLAEERKAWRKNHPHGFVARPESLNDGSVNLMVWNCTIPGSPGTDWEGGYYPLTPSFRGKYPQPTSPMEVSPGFFSPPNVFPQGKLSALFFLKKNKLWEPLSPFLNKFFLGKKEFFC

SEQ ID NO: 40574 - DNA, 661 bp, Zea mays
  misc_feature: Ceres CLONE 1433568-F
  misc_feature: Encodes the peptide sequence at SEQ ID NO. 40575
  misc_feature (335)..(335): n is a, c, t, g, unknown, or other
ggagctccccgcggtggcggccgctctagaactagtggatcccccgggctgcaggaattcgcacgagaccattacctagaacatcctaatcgaaaaatcaacaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaacaactcctccctcatcgcaccaccgccgtcgcccacagcacngcgtgccctccgcccgcgtcagctccggggcaagtgccccagaaccccctgaaactgggcgggtgcgccacgtgctgggcctcgtcaaggtgccatcggaaggggcccaccgatcgtgctgccccttgtgggacggttccccacccggaaggccccgtttgcttttgccccggttaagggcaaaggggtcggggaaaacctaaagcccccaaaaactccccccggccccaaatagggggaaaaaaccccccccggggtttccggggccccaaaaaaaataaaaagggggaaaatcccccaaaattttctgggcgccgcgaaatttt

SEQ ID NO: 40575 - protein, 106 aa, Zea mays
  misc_feature: Ceres CLONE 1433568-F
MASVTRFPAVALVLLLAASAFLASEVAACGGCPKQLLPHRTTAVAHSTACPPPASAPGQVPQNPLKLGGCATCWASSRCHRKGPTDRAAPCGTVPHPEGPVCFCPG

SEQ ID NO: 40576 - DNA, 616 bp, Zea mays
  misc_feature: Ceres CLONE 1433593-F
  misc_feature: Encodes the peptide sequence at SEQ ID NO. 40577
  misc_feature (507)..(507): n is a, c, t, g, unknown, or other
acccgcggtggcggccgctctagaactagtggatcccccgggctgcaggaattcgcacgagaccattacctagaacatcctaatcgaaaaagacgcaggcggcaggcggcggcgcaccgcaccgcttcgtcctcttctatctctcatctacagccttcgctgcgccgccatggccaccacccgcttgctgccgctgctccgacgccgcctcgccgccgcaatcgccggatcgcctgctccctactccctccgaggaccctcatttcctgcaccagcagctgcagggctaaggtccctcctaacagttgctggagcgagcgatactgcaacagaaccccaggaccaacagcattccgaaacaactcccccgccggcttctgtcccgacaccggagtccggtctcaaagtcagggacacctccaacctgaagatctcaccaaggcatgacctcgccatgatctttacgtgcaaggtgtgcgagacccagtccatgaagatggccagcanggactcgtacgagaaacgagtcgtggtcgtgcggtgcggtggctgcaaacacctccactcatggcggacagctgggctggtttgggagccagggacatcgaggactccc

SEQ ID NO: 40577 - protein, 149 aa, Zea mays
  misc_feature: Ceres CLONE 1433593-F
  misc_feature (94)..(147): Pfam Name: zf-DNL Pfam Description: DNL zinc finger
  misc_feature (113)..(113): Xaa is any aa, unknown, or other
MATTRLLPLLRRRLAAAIAGSPAPYSLRGPSFPAPAAAGLRSLLTVAGASDTATEPQDQQHSETTPPPASVPTPESGLKVRDTSNLKISPRHDLAMIFTCKVCETQSMKMASXDSYEKRVVVVRCGGCKHLHSWRTAGLVWEPGTSRTP

SEQ ID NO: 40578 - DNA, 682 bp, Zea mays
  misc_feature: Ceres CLONE 1433609-F
  misc_feature: Encodes the peptide sequence at SEQ ID NO. 40579
  misc_feature (390)..(390): n is a, c, t, g, unknown, or other
  misc_feature (401)..(401): n is a, c, t, g, unknown, or other
  misc_feature (408)..(408): n is a, c, t, g, unknown, or other
  misc_feature (416)..(416): n is a, c, t, g, unknown, or other
  misc_feature (468)..(468): n is a, c, t, g, unknown, or other
  misc_feature (640)..(640): n is a, c, t, g, unknown, or other
ggagctccccgcggtggcggccgctctagaactagtggatcccccgggctgcaggaattcgcacgagaccattacctagaacatcctaatcgaaaaaaaaggacactagtattggcccatcttcatcttcgtcgcagcgccggcgctccatctttcgctccatcccttactcgcgctcggcacaccggttctcagggcggcggcgctcaggctcgggctctcagcgacggcgtcaacggcttcccctcccgcctccgctcctccgcacaccggccggtgaccctgctcttatggcggcaagcgcgggcgagagccagggggtggaaagactcctctcctatgctgaagatctcgtggccgtcctttgcgtcagcaccgactgcgacgacnatgcacaggtncgtgccngagtgcanaagctgctgtctgcctgtcgatccgagtctgacgatctcgagatgcagctcnaagagtatcaggaaaaaataccctcctgcaaggaaaagattgacaaggcaaagctgaaaccttaactgacgaagaacctcatgccctacaaagcaggatggaaaaaaaactgcgggaaagaaaacccctttccccaaaaataaaaagtgtccctggggggttttggaacctnaaaaacccaaaattttttttaaaaaaaaaaaagggggcgtca

SEQ ID NO: 40579 - protein, 80 aa, Zea mays
  misc_feature: Ceres CLONE 1433609-F
  misc_feature (34)..(34): Xaa is any aa, unknown, or other
  misc_feature (40)..(40): Xaa is any aa, unknown, or other
  misc_feature (42)..(42): Xaa is any aa, unknown, or other
  misc_feature (60)..(60): Xaa is any aa, unknown, or other
MAASAGESQGVERLLSYAEDLVAVLCVSTDCDDXAQVRAXVXKLLSACRSESDDLEMQLXEYQEKIPSCKEKIDKAKLKP

SEQ ID NO: 40580 - DNA, 643 bp, Zea mays
  misc_feature: Ceres CLONE 1433616-F
cgcggtggcggccgctctattcctagtggatcccccgggctgcaggatttcgcacgagaccattacctagaacatcctaatcgaaaaacctaccccttctggttctgcgtgttctatctgcaatcaacgacggcgcgtctcgacggtactgctaattagcctcctagccagcctccgcctggaggtccatccccgacctcgacgcttcccggccaaacgccgacgcccctcaccctcggcgcagcgccgcagcgtcgcggtgctccatacccatccccctccatggccggcgactgcatcccccggcatcgcggtgctggatcccctccctctctcgcgttacgctagagttcgagaaggggaaaagcgacgtagggttcggcaacgacacctctgtgtcccctcctccctcgcgcactcattttccttcgtctcgttgctactcagaggtttgacacactctccaatctacgtttcctagctgctagggcttttatttttgcatgcctcttcttactctccgaattcctcttggtcgcctggcaaagtgcgttccatccgagcggtgatgtgaaaagtgtcccccctattctccatcggtttgtttgccatgattgaaaaagaagtgcctcttcgcccttga

SEQ ID NO: 40581 - DNA, 672 bp, Zea mays
  misc_feature: Ceres CLONE 1433630-F
  misc_feature: Encodes the peptide sequence at SEQ ID NO. 40582
  misc_feature (393)..(393): n is a, c, t, g, unknown, or other
  misc_feature (415)..(415): n is a, c, t, g, unknown, or other
  misc_feature (416)..(416): n is a, c, t, g, unknown, or other
gctctagaactagtggatcccccgggctgcaggaattcgcacgagaccattacctagaacatcctaatcggaaagcacctacgttactgctgaagatccagccggcacaccatcggcgaagaagaggccggagagaggatgatactggccgtgctcttcgccaactccgatggaaacatccttgtcgagcgattccatggggttcccgcggaggagaggctccactggcgctccttcctggtgaagctcggatccgagaacctcaaagggtccaagaacgaggagctccacgttgcctcccacaagtctgtgtctattgtttataccacggtcggggatgtctgcctctacattgttggcaaggatgaatatgatgagcttgctttggctgangtgatctttgcaattacatcanncagtcaggatgtttgtgcgaaaactcccacccgagcgcctctttcttgacaaataccggaggatctgccttgggcttgaataaaatggtttggaaggggttgctttaaaccccggaaaaaaaccagagggggggggttaattaaaaaaaaccccccggggggacccctaaatttgcggtgaaaacttttttgtgggggtttgttgaacccccaacccactcccctttgtggtttgggggggaaattttttgagatt

SEQ ID NO: 40582 - protein, 108 aa, Zea mays
  misc_feature: Ceres CLONE 1433630-F
  misc_feature (85)..(85): Xaa is any aa, unknown, or other
  misc_feature (93)..(93): Xaa is any aa, unknown, or other
MILAVLFANSDGNILVERFHGVPAEERLHWRSFLVKLGSENLKGSKNEELHVASHKSVSIVYTTVGDVCLYIVGKDEYDELALAXVIFAITSXSQDVCAKTPTRAPLS

SEQ ID NO: 40583 - DNA, 677 bp, Zea mays
  misc_feature: Ceres CLONE 1433638-F
  misc_feature: Encodes the peptide sequence at SEQ ID NO. 40584
  misc_feature (530)..(530): n is a, c, t, g, unknown, or other
aagctggagctccccgcggtggcggccgctctagaactagtggatcccccgggctgtaggaattcgcacgagaccattacctagaacatcctaatcgaaaagaacgcgatctgttccccagcctccgcagccgcttcaccgccctccactccggctgccgaatcgacccgccccgatccacatcaggagctgagggatggacgcgaacaggcgccagagtgggatccagcagttgctggctgcggagcacgatgctcaccacattgtgaatgcggctagagctgccaagtcagcgaggcttaggcaagcaaaagacgaggctgagcgggaaatagctgactaccgtgcccagatggagtctgagtttcaaaggaacgttgcatagagcagcggctactccggtgcaaacgtcaagcgtctcgaggaatagacggcggcgaagattgaacaactcacccagcacgccgcaagcatctccccggatgtcattcatatgcttctgcggcatgtcatcaccgtcaagaactgangagtgctgttgcagaactatgctcgcagacttgtaccgtcgatctatttatttttgtcaaaattgaacatgctgaggaatatatggccagcttgattcataattccggttccaaatacggaaaaagccgcccctgttttagcggaaa

SEQ ID NO: 40584 - protein, 62 aa, Zea mays
  misc_feature: Ceres CLONE 1433638-F
  misc_feature (5)..(62): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
MDANRRQSGIQQLLAAEHDAHHIVNAARAAKSARLRQAKDEAEREIADYRAQMESEFQRNVA

SEQ ID NO: 40585 - DNA, 677 bp, Zea mays
  misc_feature: Ceres CLONE 1433662-F
  misc_feature: Encodes the peptide sequence at SEQ ID NO. 40586
gtccccgcggtggcggccgcggtattaccctggatccgccgggctgcaggaattcgcacgagaccattaccagaggcatcctaatcgaaaatttttttcattcacgtcggcccggcctcttctccccccgacgcgcttgccgatccgcccatcccgccgctaccactctccggccgccgccgcgcgcctcagccgcccgtggcccggagatggagggcgccgccggggaggagggcgcctccacgccggcggcgagagggggagcggaggcaggggcaggggcaggggcagggatgctgaaggggaggtcctgcaagggctgcctctgccactcgtcaaagctcaggtcgcgagagcgcggccccgtctgcgtcggcgtcacccgcgcccttccccaagtttctgagcgtaaggttgcagaacttgaactggaagctttccaagaaagtcgttaccctgcccatttcagatatgcatgcattggctagtccatgtacttaaatggacaggaaaattgctaccgcggttaccaaaaaaagccacgttgccccgcctgccccggcttgtgccgggaatcccaacctgtttggtaagaaattaaaaaatccgcctcccaaacggtttaagaaaagaaagcctcccaaaaacccaccgtgcaaatattaaaacaccagtag

SEQ ID NO: 40586 - protein, 92 aa, Zea mays
  misc_feature: Ceres CLONE 1433662-F
MEGAAGEEGASTPAARGGAEAGAGAGAGMLKGRSCKGCLCHSSKLRSRERGPVCVGVTRALPQVSERKVAELELEAFQESRYPAHFRYACIG

SEQ ID NO: 40587 - DNA, 630 bp, Zea mays
  misc_feature: Ceres CLONE 1433671-F
  misc_feature: Encodes the peptide sequence at SEQ ID NO. 40588
tggagctccccgcggtggcggccgctctagaactagtggatcccccgggctgcaggaattcgcacgagaccattacctagaacatcctaatcaaaaactcttcctccttcccacctacccttcttcctcgcagcagccttatctcttctccggctcagcctagcaaagccttctccggccagcgagagagaaaggaagtggaggcatgaagatccagtgcgactcgtgcggcgtcgcggcggccacggtggtgtgctgcgcggacgaggcggcgctgtgcgcgcgctgcgacgtggagatccacgccgccaacaagctccgccagcaaagcaccagaggctcccggctcgacgcgcttcggggccaaagttccccgccttgggaaatttggccagaaaaagggccccttttttttttggcccaagagaggggggtttttttgcccggaatgggaaaaaaccttttttgttcccggggaccctttccggggaaaaaccaagggtttttccccccccccgggggttcccgggggggttttggcccccctttttcctgttgggcccgggggagaaaaaaaggggccgaaaaaaaaaaaaaaaaaaaaaacctcgccccaagagagggggggcg

SEQ ID NO: 40588 - protein, 141 aa, Zea mays
  misc_feature: Ceres CLONE 1433671-F
MKIQCDSCGVAAATVVCCADEAALCARCDVEIHAANKLRQQSTRGSRLDALRGQSSPPWEIWPEKGPLFFLAQERGVFLPGMGKNLFCSRGPFPGKNQGFFPPPGGSRGGFGPPFSCWARGRKKGAEKKKKKKNLAPREGG

SEQ ID NO: 40589 - DNA, 675 bp, Zea mays
  misc_feature: Ceres CLONE 1433674-F
  misc_feature: Encodes the peptide sequence at SEQ ID NO. 40590
  misc_feature (675)..(675): n is a, c, t, g, unknown, or other
cgcggtggcggccgctctagtcctagtggatcccccgggctgcaggaattcgcacgagaccattacctagaacatcctaatcgaaaaagtcctcacactgacatttcactctcggctgctggagtgtcggccgctgccatctgcctgccgctcactcccacgcgccgcaatgtgccactccccactcggcgccgccaccaccaccgcgggggcgctagcgctcctcttcctcctgccgctagcctcggccgccgccgccggcggcggcaccgcggcgaaggcgacgcccaacatcacggcgctcatgtccaagggcgggtgcaaggtgttcgcgtcgctgctggacaagtcccccgacgctctgtcggcgttcgagtcggcggtgagcggcggcgtgacggtgttctgcccgacggacgaggccgtgcgcgggttcatgcccagctaccggaacctgagcgcggacggcaaggcgtcgctgctgctgttccacgcggtgccccggtgtactacacgctgcgggggcctgaaatccagcaaacgggcccaataaacaccgctggccaacgaacggtcgccggccagcaaactaccaaccctgaccgtgccaaacacgcagggcgaaccaaggtgaacacctgcggaaacgcccgagccgccgaacaccgccggccn

SEQ ID NO: 40590 - protein, 127 aa, Zea mays
  misc_feature: Ceres CLONE 1433674-F
MCHSPLGAATTTAGALALLFLLPLASAAAAGGGTAAKATPNITALMSKGGCKVFASLLDKSPDALSAFESAVSGGVTVFCPTDEAVRGFMPSYRNLSADGKASLLLFHAVPRCTTRCGGLKSSKRAQ

SEQ ID NO: 40591 - DNA, 687 bp, Zea mays
  misc_feature: Ceres CLONE 1433681-F
  misc_feature: Encodes the peptide sequence at SEQ ID NO. 40592
aagctggagctccccgcggtggcggccgctctatactagtggatcccccgggctgcaggatattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgataacggcgggtgcaagtgcggcggcaactgccagtgcgacccctgcaactgcggtaagtgacccaagtgctccaccctgcaggccggccagaggaagctagctaattataaagcttaataaagtatagcggcgtcgctgtgtgtgtttcgagtcagtcaatcagttgcgtgccatggcttgctctgatcctgagatgatgatgatggctgatggcggcgtcatgtcctcccctgggctcctggggcgcttctggcgagcaatgtgttgtgttgtggggttgccccacgctatcaggcttgccctgtgcccggctgtgttgtgtcaccttcg

SEQ ID NO: 40592 - protein, 82 aa, Zea mays
  misc_feature: Ceres CLONE 1433681-F
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHAEGGFEAAAGADNGGCKCGGNCQCDPCNCGK

SEQ ID NO: 40593 - DNA, 711 bp, Zea mays
  misc_feature: Ceres CLONE 1433682-F
  misc_feature: Encodes the peptide sequence at SEQ ID NO. 40594
  misc_feature (423)..(423): n is a, c, t, g, unknown, or other
tggagctccccgcggtggcggccgctctataactagtggatcccccgggctgcaggaattcgcacgagaccattacctagaacatcctaatcgaaaaattagttcagcacagttcatcttcctcgcagcgccggcgctccatcttccgctccctcccccaccttcgatcggcacgcaggctcggcgtcttcgtcagcggttcctcctcccgcctctcgccagtagcctcgcgccctcgccgactggcgaccctgccttgaaggggctggcaagatgatcggcgtagggaaggcgaagcagtacgccaacgtccttgacaagccccgcagccgtggcaggcaggaggtaaggttgagtgcatttgcattcttgttctctgagttggttcagtacaaccagactcaggttgcgcccctttctganctggaacggaggctggaggatgctgggtatgctgttggggcaagggtgcttgaaacaccctgtcaccgggagaaggaaaaaaaacgaaagacacgaacttcggggtatttttatccttcattccacagctactggtttggaaaaaggtttgatttggaaaaaggtggcttgacctcccccttgaaagggggaatccgaacccccgaaggaaggaattccttggattccgggggaaataaaggaaccttctctggcgtagtccgggcttcccattttcctgggggccca

SEQ ID NO: 40594 - protein, 146 aa, Zea mays
  misc_feature: Ceres CLONE 1433682-F
  misc_feature (50)..(50): Xaa is any aa, unknown, or other
MIGVGKAKQYANVLDKPRSRGRQEVRLSAFAFLFSELVQYNQTQVAPLSXLERRLEDAGYAVGARVLETPCHREKEKKRKTRTSGYFYPSFHSYWFGKRFDLEKGGLTSPLKGGIRTPEGRNSLDSGGNKGTFSGVVRASHFPGGP

SEQ ID NO: 40595 - DNA, 663 bp, Zea mays
  misc_feature: Ceres CLONE 1433689-F
  misc_feature: Encodes the peptide sequence at SEQ ID NO. 40596
  misc_feature (637)..(637): n is a, c, t, g, unknown, or other
tccccgcggtggcggccgctctagaactagtggatcccccgggctgcaggaattcgcacgagaccattacctagaacatcctaatcgaaaagcatgcgaatactgctggagttggcctaacccaacgaccagacgcaacacgacggcgacggccatggcttcgccggacctcgccgccggcgacggcagctacgactttcaccttcgctctctctccgcggcctcacgggactccgctgcggcctccgaccccgcctctgaccccaacctcctccaatctgttaggagggtgtgcgagatgtgccgaacggcgaaggaagcgaaggacgagatggtggcgcgggcgttccccgtgatgggcaagctatttcagcgatgcgccgccgctcccacgcatgccgttgcctccaccggcgtgctgctcctcgtaagccgactttttcttagtcttgtgctgcggagatgttatccttaacgttttgatggataaaggttcggatatctgaaaacagtgtccttatgcgtagaaatggacttctccgttttcagttttatcaaaattttgcgctcgacgccactatgtctagtctttgggtgagagactttaatctagtgttagctttatgaataatgtccntactccccgatttacagacaatggat

SEQ ID NO: 40596 - protein, 106 aa, Zea mays
  misc_feature: Ceres CLONE 1433689-F
MASPDLAAGDGSYDFHLRSLSAASRDSAAASDPASDPNLLQSVRRVCEMCRTAKEAKDEMVARAFPVMGKLFQRCAAAPTHAVASTGVLLLVSRLFLSLVLRRCYP

SEQ ID NO: 40597 - DNA, 548 bp, Zea mays
  misc_feature: Ceres CLONE 1433697-F
  misc_feature: Translation starting site: 214
  misc_feature (344)..(344): n is a, c, t, g, unknown, or other
cgcggtggcggccgctctagaactagtggatcccccgggctgcaggaattcgcacgagaccattacctagaacatcctaatcgaaaactaccagccaccaggtgtcgtcccaggcggtgaccttgccaaggtccagagggctgtgtgcatgatctccaactccaccagtgtcgtcgaggtcttctcccgcatcgaccacaagtttgaaccctgatgtacgccaagcgtgccttcgtccactggtacgtcggtgagggcatggaggaaggagagtctctgaagcccgtgaggatctcgctgccctggagaagactatgaagagttggtgctgaatccaaccaagntgaagacggtgatgaaggcaatgagtattaagctggcctctgggtggttttcccaagggttggctagcggctaacccaaggaactggcccaaagggggcttttaaccgggtaacccggcccggttttaaaaccttttgccttttggggggggtttttttttttaaaacacccgtggtttggggttttttaaaaaaaaccccttt

SEQ ID NO: 40598 - DNA, 660 bp, Zea mays
  misc_feature: Ceres CLONE 1433702-F
  misc_feature: Encodes the peptide sequence at SEQ ID NO. 40599
  misc_feature (633)..(633): n is a, c, t, g, unknown, or other
acccgcggtggcggccgctctagaactagtggatcccccgggctgcaggaattcgcacgagaccattacctagaacatcctaatcgaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacagcgggacgacgacgacgatggtggcggaggcccgggtgtgcatgggcaagagccagcaccactcgttcccctgcatctccgaccgcctctgcagcaacgagtgcgtcaaggaggacggcgggtggaccgccggctactgccacctccgctactgcaggtgccagaaggcgtgctaagcaaagctcttcaaacacccttggcttgccagaactgaactctagtagtactaagtaacacccttggctagctgtgcacaacctacgtaccgtgcatgcatgtaatgtggtgtcatgtaacgtgacagcaataaatagtattaataataataacacggcatgtagccaagcaacagactgtgcggtcccaccgggtcagcgaccgtttccgatttccatccanccgcagagtcactaagctcagtcaacc

SEQ ID NO: 40599 - protein, 82 aa, Zea mays
  misc_feature: Ceres CLONE 1433702-F
  misc_feature (36)..(82): Pfam Name: Gamma-thionin Pfam Description: Gamma-thionin family
MELIKSRATVCALLLALLLLSHYDSGTTTTMVAEARVCMGKSQHHSFPCISDRLCSNECVKEDGGWTAGYCHLRYCRCQKAC

SEQ ID NO: 40600 - DNA, 709 bp, Zea mays
  misc_feature: Ceres CLONE 1433805-F
  misc_feature: Encodes the peptide sequence at SEQ ID NO. 40601
  misc_feature (709)..(709): n is a, c, t, g, unknown, or other
tggcggccgctctagaactagtggatcccccgggctgcaggaattcgcacgagaccattacctagaacatcctaatcgaaaagtggatctcgtgttcctgcagcggatgctctgcacgctgtgttccggcagtggagactggagggcggcgcggcgatggaggacccgtgcaggaagggcgtctggtcagagtcgtccggaataaacgcgtccgtcgaatgcaactgcctcccctcaagggtgtgccgcatcacaagcctaaatgtgagtgggcacgggaacatctcggcgatcccgcgggagctattcaatttgacagaactggtctctctggatttaagtaataacaacttgagtggttcgatacccccggaagttattaatctttccaaactggaaacatgctaggcacttcaataataatcctctcagtggaggttttcctcatgaactgtcgcttttaaggaatctacggtccctgtggatgtttgataattacattgtagggccttttccggcatttattcagaacttaaccaatctcacagacttgcgaatatatgggacgaatcttcaaggacctattccaaaaaatttctctaatctgagcaatcttgaagtcctgatgcttggtgatcttgcgggcaactattcttatttaaatgtcataggagcgtgggcaaacctttcagtgttatctctgagaaan

SEQ ID NO: 40601 - protein, 74 aa, Zea mays
  misc_feature: Ceres CLONE 1433805-F
  misc_feature: SWISSPROT Homolog: EC 2.7.11.1 Non-specific serine/threonine protein kinase
MFDNYIVGPFPAFIQNLTNLTDLRIYGTNLQGPIPKNFSNLSNLEVLMLGDLAGNYSYLNVIGAWANLSVLSLR

SEQ ID NO: 40602 - DNA, 726 bp, Zea mays
  misc_feature: Ceres CLONE 1433807-F
  misc_feature: Encodes the peptide sequence at SEQ ID NO. 40603
  misc_feature (516)..(516): n is a, c, t, g, unknown, or other
acccgcggtggcggccgctctagaactagtggatcccccgggctgcaggaattcgcacgagaccattacctagaacatcctaatcgaaaaacccacacatccgacgccgaggaagtaggaagcacgaccagcatatgtcacagagggccagcgtcccacactcctcctgcatagccttcgcgctccattcccatctcctggtctccagtgagatgtgccccagctcctattggcagcaatagctattctccgccttcctttttttcttcttcttcttcctttcctcccgtctggatttcgtttccgtttgatcgagctggctctcagcttccgtttttagttttgttggcatctttgctctcggatccgtctctccctaactcctgaaacccaaaaggagagaagaaaccgggcaagcaagcgatgggtgtcaagggattcgtcgagggcggcatcgcctccatcgtggccggctgctccacccacccgctggacctcatcaaggtccgcatgcanctgcagggggaggcggcggccgccgtggccccgcagccggcgctgcgcccggggctcgcctttcacgcggggggccacgccgtcgcgcttccggaaccacaacaacttcccggggccccccctaaaccccggacccgctgggcgtacggcgccacagatccttgcgggccgaagggcccccccggaccttctttctcagagggtagtccc

SEQ ID NO: 40603 - protein, 101 aa, Zea mays
  misc_feature: Ceres CLONE 1433807-F
  misc_feature (31)..(31): Xaa is any aa, unknown, or other
MGVKGFVEGGIASIVAGCSTHPLDLIKVRMXLQGEAAAAVAPQPALRPGLAFHAGGHAVALPEPQQLPGAPPKPRTRWAYGATDPCGPKGPPGPSFSEGSP

SEQ ID NO: 40604 - DNA, 738 bp, Zea mays
  misc_feature: Ceres CLONE 1433820-F
  misc_feature: Encodes the peptide sequence at SEQ ID NO. 40605
ccccgcggtggcggccgctctatactagtggatcccccgggctgcaggaattcgcacgagaccattacctagaacatcctaatcgaaaatatcaattcactgattaatttggtgttggtttgcatgacgcagggcccgacgttcggcgccatgatgatctccggccagaaggcggcgcacctggcgctgaaggcactgggcaggcccaacgccgtggacgggaccatccccgaggtgtcgccggcgctgcgcgaggagttcgtgattgcgtccaaggacgacgaggtcgtggacgcctgagcgagcatccacgcgccagcatgcaagcagcgtcttatctgggccggcgccatcacggggtttcttccttttatctgggactttgtttgttgtgggacgaatgacctcccttccatcgggtagcttttaatctgccccgctaggcggcctgggtccttgtagccccctgccccagcttcccccctgcccgggggcttctgtccccgggggggccccccctgggggcccccctcttgcttgttaaacccaataaaaaaaaaaggaaattgggggggaaaacaaaaaaacgggggggggtaaaataggctcaaaaaaaaaaaaaaaaaaagtttttcggtcccctccaccccccggggggggggcccgggggcccaatttcccccccaagagggagggcaaataccccgccccccctggcccctttttatcaacagccgg

SEQ ID NO: 40605 - protein, 58 aa, Zea mays
  misc_feature: Ceres CLONE 1433820-F
MTQGPTFGAMMISGQKAAHLALKALGRPNAVDGTIPEVSPALREEFVIASKDDEVVDA

SEQ ID NO: 40606 - DNA, 781 bp, Zea mays
  misc_feature: Ceres CLONE 1433821-F
  misc_feature: Encodes the peptide sequence at SEQ ID NO. 40607
gtagccccccctcccccttcccccatccgcttcctttttgcttatcatatacactggactccccgcggtggcggccgctctattctagtggatcccccgggctgcaggaatttgcacgagaccattacctagaacatcctaatcgaaaaacgaccacgccgcgcctccgcctggaaccctttagccgagcggagcaaggaaagaaatggggaagggtacgggcagcttcggcaagcgccggaacaagacgcacacgctctgcatccgctgcggccgccgcagcttccacctccagaagagcacctgctcctcctgcggttaccccgccgcccgcatccgcaagtataactggagtgcgaaggtcatcaggtgtaagaccactggtaccggaaggatgatgtacatgcgatatgtgcctcgccgtttcacgagcaacttcagagaagggactgaggctgccccaaagaacgccgttgctgctgcccactaagtgcggtcttgctgccactcacgaagcgctagaactcgagactttttgactgaattgtacttctggaaccatttagcccataatactacgcttgaatcaacttcacaccccctggagcggtatatgtactctttttggggagaatggttctagtaccgctctggcccccggttaccgcaagggaataaagccttatcggatacccctctaaccctcgaagggggggggcccccgttaaccaaattccgcccctagaagggggaggtccagtatataccccgccgcccaccc

SEQ ID NO: 40607 - protein, 94 aa, Zea mays
  misc_feature: Ceres CLONE 1433821-F
  misc_feature (2)..(55): Pfam Name: Ribosomal_L37e Pfam Description: Ribosomal protein L37e
MGKGTGSFGKRRNKTHTLCIRCGRRSFHLQKSTCSSCGYPAARIRKYNWSAKVIRCKTTGTGRMMYMRYVPRRFTSNFREGTEAAPKNAVAAAH

SEQ ID NO: 40608 - DNA, 726 bp, Zea mays
  misc_feature: Ceres CLONE 1433831-F
  misc_feature: Pfam Name: Bap31 Pfam Description: B-cell receptor-associated protein 31-like
  misc_feature (426)..(426): n is a, c, t, g, unknown, or other
  misc_feature (438)..(438): n is a, c, t, g, unknown, or other
aaagctggagctccccgcggtggcggccgctctagaactagtggatcccccgggctgcaggaattcgcacgagaccattacctagaacatcctaatcgaaaactgacttcttatagcatcatcccaagtcctcgcccggactccgcagattctctggttgctacgagttcttcgcctggtttttgggcaaggccaaaatttctgatttttttccaccgccgcaaacccctttgctgtgccataccgccattccattcctaagctgggcgtgggcgggtgaagaaaggaagcgaggccggctgtttcgctgaaaccccgccgcctttttttccttttcttttctggacctgattgaagaaccgtagcaaattaggggagggaggagcggcggcggccggtcggtcggtcagtatgattcacctgctngtcctcgtgctngtcgcggaggcgcggtagcgctgctccctcatgtgaagtcgggccgctgcgggagctggcaatgcgcctcctggaccaggtgaagacggcaagggccccgcaaccgtcaagaacctggcatgcacccttctcgtcaatcttcatgtcaaggttcgccgggatcctaaaaatcaaaaatcgggggctcaaagtctggacaccttaaccccaatggaacaggtgctttggaaaaaccccctccttgagggatcctttcccggaaaaaccccttttccttgcaatttaaaa

SEQ ID NO: 40609 - DNA, 689 bp, Zea mays
  misc_feature: Ceres CLONE 1433835-F
  misc_feature: Encodes the peptide sequence at SEQ ID NO. 40610
tctccgcggtggcggccgctctagaactagtggatcccccgggctgcaggaattcgcacgagaccattacctagaacatcctaatcgaaaaaaattccctacggggtgaagccttgtgtttcttccaagcatccaaagagcccttagcaattccccgcgtcggtgatcgggcccattgccatctgcccatctctaccgacgaccaactgaactgaccgagtgagcgacgccgacctcgggctggtcggggcgatccggttccaggcttccggccatggcgaagccgccgcgggcgccgaggcccaaactgcagacgccgcgggcgccggcccggcggctcctcggcctcggcgggctgggcgtcgcggcggcggcgtacgtgggcgtggactacttgcggcacctctcgccggcgtggcacggccggctgcagccggcgctgtgggcggtgctggcgctcgcggccgccgcgcgcgcgccgttctaccgccactggtccgcggagctgcgcgccgcactgcccttcctgggatccatcgccttcatgctcgccgccttcctctgcgaggccatctctgttcgcttcgtctccgccgtcatgggactgcactggcactgaactgccgcaccgcttcctgacactggtcaatggctgcttctatcattgaacgagaagctccctcagagcg

SEQ ID NO: 40610 - protein, 114 aa, Zea mays
  misc_feature: Ceres CLONE 1433835-F
MAKPPRAPRPKLQTPRAPARRLLGLGGLGVAAAAYVGVDYLRHLSPAWHGRLQPALWAVLALAAAARAPFYRHWSAELRAALPFLGSIAFMLAAFLCEAISVRFVSAVMGLHWH

SEQ ID NO: 40611 - DNA, 773 bp, Zea mays
  misc_feature: Ceres CLONE 1433839-F
  misc_feature: Encodes the peptide sequence at SEQ ID NO. 40612
  misc_feature (510)..(510): n is a, c, t, g, unknown, or other
ctccccgcggtggcggccgctctagaactagtggatcccccgggctgcaggaattcgcacgagaccattacctagaacatcctaatcgaaaattgaactttaatagtcttattgaagatggatctaccatgaagctcaagattgcaaagagatgtctcattatattttgcgcacttgttacacgtcaccggaaacatacagataactagatgccacatattgtccactgtgcaataaaaatatcaaaacaaaggcatccatttaagtaaactcgactctctccccaatcggattgtttcattggcatttgatgtgatttctcgagttttggaaacaggaccggggatggtgaccacctttccccagcattttttcttcccttcctggaatccggcaaatttttccccccctttccccttggaatggggaagggttattttaaaaaatggggggggaggaataccctggaggaagtttatttgcaaaaaggaaaacctcccctttcgaggnatgggagggaacttttctcggggaagggaccggagggatttgttttcccctggccccaaaaaaagggccaaaccaattttacttggggggttatataccgccctatcaaaaggggtcccccccgcgtttgcgttcttgcccgctttcaaaaggcgctaaagaaagggggataaaaaaaaaaaaggggaaaacctgaaaatggaacccccatttgggggaggtttttgggcccatcccacttcccctggcaaagattttccctg

SEQ ID NO: 40612 - protein, 68 aa, Zea mays
  misc_feature: Ceres CLONE 1433839-F
PRGGGRSRTSGSPGLQEFARDHYLEHPNRKLNFNSLIEDGSTMKLKIAKRCLIIFCALVTRHRKHTDN

SEQ ID NO: 40613 - DNA, 731 bp, Zea mays
  misc_feature: Ceres CLONE 1433841-F
  misc_feature: Encodes the peptide sequence at SEQ ID NO. 40614
  misc_feature (425)..(425): n is a, c, t, g, unknown, or other
  misc_feature (495)..(495): n is a, c, t, g, unknown, or other
  misc_feature (510)..(510): n is a, c, t, g, unknown, or other
tccccgcggtggcggccgctctagaactagtggatcccccgggctgcaggaattcgcacgagaccattacctagaacatcctaatcgaaaaaaattctgattttttgttcccttcaccgacggcgaggagtgagggttgacaacgggatggcgcggagcgtatcgtacgtttcggcggcgaagctggtatccatggcgcgaggcaatccccgcctcgccatcatcgacgtcagggatgaggagaggagctaccaggctcacatcgcgggttcgcaccacttcgccagcggcagcttcgaggcgcggatgccggagctggtgcgggccgccagcggcaaggacaccctcgttttccactgcgcgctgagccaggtacgaagtcaaacttgtgctcggatgttctcagactatctatcggagaccanggaggattcagggataaagaacatcatggtactgggagcgcgggtttaacgggatgggaggtttcagggnagcccttgtctgcanctgcacccaacctcattggcaaagggacttggtctttaaccccccgagtttttttctccccttaggcctttaaaaaccaaggatccggatggccccccgttttcctttggcggggggtccttcccccccttaaaaccccttaaaaaggttggaccccccaaaaaaaaaaaaaaaaaaatttttttcttcccccccaccccgggggggggcccgggaacact

SEQ ID NO: 40614 - protein, 108 aa, Zea mays
  misc_feature: Ceres CLONE 1433841-F
  misc_feature: SWISSPROT Homolog: EC 3.1.3.48 Protein-tyrosine-phosphatase
  misc_feature (93)..(93): Xaa is any aa, unknown, or other
MARSVSYVSAAKLVSMARGNPRLAIIDVRDEERSYQAHIAGSHHFASGSFEARMPELVRAASGKDTLVFHCALSQVRSQTCARMFSDYLSETXEDSGIKNIMVLGARV

SEQ ID NO: 40615 - DNA, 709 bp, Zea mays
  misc_feature: Ceres CLONE 1433844-F
  misc_feature: Encodes the peptide sequence at SEQ ID NO. 40616
  misc_feature (358)..(358): n is a, c, t, g, unknown, or other
  misc_feature (366)..(366): n is a, c, t, g, unknown, or other
  misc_feature (367)..(367): n is a, c, t, g, unknown, or other
  misc_feature (412)..(412): n is a, c, t, g, unknown, or other
  misc_feature (416)..(416): n is a, c, t, g, unknown, or other
  misc_feature (417)..(417): n is a, c, t, g, unknown, or other
  misc_feature (425)..(425): n is a, c, t, g, unknown, or other
tacccgcggtggcggccgctctagaactagtggatcccccgggctgcaggaattcgcacgagaccattacctagaacatcctaatcgaaaaactccaaacctccctctctcgacctcgacccctcgcccgcaaagccccgcaagccagcggcatcccgcttcctcggcaggcttccaagacccaacccaacagcttccgagcgagtacggcggcggcgacgatggcggccaagtcgcacacacgcaaggcgttcctcctctgcaactacgtcctcctgggcgcctcctccagctgcatcttcctcacgctgtcgctgcgcctgctgccgtccccgtgcggcctgctcctgctcttccntcacgccnntcacgccgtcttctccgcggccggctgctcgggctccttcacggngccnngcacgccngcgcagtggcacaacgcgcacaccgcgggagccgcgctcaccgccatctttcagggcggcatcgcggtggctcgggttacccgaacttccgaattcctcggcaagttccattctacgtccggaagaagaaggggccctcaatcctcaaaagggcgggagggttgggaacccctattttttccttgagggggcccggccccggttttggctttccctccccccccaaaaaaagagacaaaaaaaaaaaaccccccggaaaaaaatgggaaatctccccgtgggtg

SEQ ID NO: 40616 - protein, 129 aa, Zea mays
  misc_feature: Ceres CLONE 1433844-F
  misc_feature (46)..(46): Xaa is any aa, unknown, or other
  misc_feature (49)..(49): Xaa is any aa, unknown, or other
  misc_feature (64)..(64): Xaa is any aa, unknown, or other
  misc_feature (66)..(66): Xaa is any aa, unknown, or other
MAAKSHTRKAFLLCNYVLLGASSSCIFLTLSLRLLPSPCGLLLLFXHAXHAVFSAAGCSGSFTXPXTPAQWHNAHTAGAALTAIFQGGIAVARVTRTSEFLGKFHSTSGRRRGPQSSKGREGWEPLFFP

SEQ ID NO: 40617 - DNA, 694 bp, Zea mays
  misc_feature: Ceres CLONE 1433847-F
  misc_feature: Encodes the peptide sequence at SEQ ID NO. 40618
ctccccgcggtggcggccgctctagaactagtggatcccccgggctgcaggaattcgcacgagaccattacctagaacatcctaatcgaaaatgtgtcttccttccacctgaaaacccaacccacacgctcgcgcctccgcgaagaaaaacaccgaggcccatggcgccgagaacgtcagagagagcgatgacatcagcggcgaccgccgccgcggggctcgggctcgcgcgtggcgccggcccgcattacagaggcgtcaggaagcggccgtggggccggtacgccgcggagatccgcgacccggccaagaagacccgcgtgtggctcggcacgttcgacacgcccgaggacgccgcgcgggcctacgacgccgccgcgcgcgagtaccgcggcgccaaggccaagaccaacttctccttcccttcgtgcctgccgctcgccgccgcggacgtggccggcgccggcgcctgccggagcggcaacagcagcagcaccagcaccaccgtcgactccttcggcggcgacgtgcaggcgccgcccatgcaggccatgccgctcccaccgtccttctgcgccagcggcgccgtacgcttccctttcagcagctaccccgtgacgcacccgtattacttcttcgggcaggccgcagcagggtgccatatgctgaagctgccaccgacgacggtgactgt

SEQ ID NO: 40618 - protein, 177 aa, Zea mays
  misc_feature: Ceres CLONE 1433847-F
  misc_feature (28)..(79): Pfam Name: AP2 Pfam Description: AP2 domain
MAPRTSERAMTSAATAAAGLGLARGAGPHYRGVRKRPWGRYAAEIRDPAKKTRVWLGTFDTPEDAARAYDAAAREYRGAKAKTNFSFPSCLPLAAADVAGAGACRSGNSSSTSTTVDSFGGDVQAPPMQAMPLPPSFCASGAVRFPFSSYPVTHPYYFFGQAAAGCHMLKLPPTTVT

SEQ ID NO: 40619 - DNA, 730 bp, Zea mays
  misc_feature: Ceres CLONE 1433849-F
  misc_feature: Encodes the peptide sequence at SEQ ID NO. 40620
  misc_feature (256)..(256): n is a, c, t, g, unknown, or other
  misc_feature (309)..(309): n is a, c, t, g, unknown, or other
ctccccgcggtggcggccgctctagaactagtggatcccccgggctgcaggaattcgcacgagaccattacctagaacatcctaatcgaaaaatcctggtctcatctcttctggattgaaccctgctgtgatgcgagacagcgcaatgctggcggcgcgggaggcgaataagcggccgcgcgcagcgccgacgacgaccctccccattgccttctcactgttctacaatgagtatgtcattacgagatcatattanaaagaggagggaagaagaagatgatgacatgatgttgtttattttccctgccntatatctgatgggttcaactagaagtgggggacaaaagagaaacgtcatacatcagatgagacaactccgtatgtgtatttgtcagtattgggaaggacacctcgtaggtgggaaccatggttattaccggatttggctagggagccggataactaaataatcgggtttttggccagaatgcggaaacaattccaagccttttgggtataccgggagtggttaaattgatttaaaccgattgggggccccccggattggggaccgggcgcaaaaaccccgcagggtaggatattcgaaggggccccagggcttcccccctggtttctccccggttttgccggtgggggggggccccccttttctctccaaaaaaaaaaaaaaaaattttttctccccccccccccgagggggggggcccct

SEQ ID NO: 40620 - protein, 44 aa, Zea mays
  misc_feature: Ceres CLONE 1433849-F
  misc_feature (37)..(37): Xaa is any aa, unknown, or other
MLAAREANKRPRAAPTTTLPIAFSLFYNEYVITRSYXKEEGRRR

SEQ ID NO: 40621 - DNA, 780 bp, Zea mays
  misc_feature: Ceres CLONE 1433857-R
ttttacaattgggtaccgggccccccctcgaggtcgacggtatcgataagctttttttttttttataagaagaaattggagagcctttatttgaattctactgttagactgaaagcgtaaatttagaacaataaaaatagaggtgagcacacaaatctgatttggttgctacttgctactgctggagttactcaaagcatgcgcacgtgctcggcccgctctccactacaagatatattcgaaattgtgcacaactatatgttctaaattccagtcaataacttcgtatggcggtatggctaccaaacttggttgagatctatccctggagaagttgcttcacattacactcatgactcgtcttaggacgaatcctgcagctgcaaaacacagaaaatttggccaagacctatttatctatttacaggtaagaggaggccatgctgcgcacatctgtcggcatgaaggccagtacaaccagcaagacgagcaggcagaccggcagccacagcagcagcgactgcggcggcggcaggtgaggcagcaccagcggcagtatcagcagcgagacggtgaggcaggcgagcacgaagaatgccccgatgctgaagtaggtggacgcgatgaccctcttgtcgaggaaatccggcctcctgctgaacgcttcctgcagatgcccgcttcaccggcattccctccctttgtattggccgcccccttcctttccatccgcggctagaatcgggctttggcaatggggttccctttgggggttagggc

SEQ ID NO: 40622 - DNA, 550 bp, Zea mays
  misc_feature: Ceres CLONE 1433857-F
  misc_feature (314)..(314): n is a, c, t, g, unknown, or other
  misc_feature (425)..(425): n is a, c, t, g, unknown, or other
  misc_feature (426)..(426): n is a, c, t, g, unknown, or other
acccgcggtggcggccgctctagaactagtggatcccccgggctgcaggaattcgcacgagaccattacctagaacatcctaatcgaaaaatgttggtccttgatgcaatgtatccggccctcttcttcctccgtcctccgacctccgagatttgaaaccgtgctgcgaatcccccactcataaaattgaccactcgtcctcccccctgcccgtcatcatgcttaatctctctccagtttccccagtttccgtttccatctccatcctcccccccgggagcaggagctgcagcccagagtcgagtcggccgtcntccacgggaaaaaatccaactttccctttttaccgagatcccccctttgggtcccccccccaactccccatttggggttttttgtttttttccccccccccccccgggttnntttttgtggtcctcccctccccgggacattttttgggggggggggaaaaccccccccccttttgggggggggttctctcccccccccccccccccccccccctaaaacccccccccctttttta

SEQ ID NO: 40623 - DNA, 685 bp, Zea mays
  misc_feature: Ceres CLONE 1433858-F
  misc_feature: Encodes the peptide sequence at SEQ ID NO. 40624
cgcggtggcggccgctctagaactagtggatcccccgggctgcaggaattcgcacgagaccattacctagaacatcctaatcgaaaaattctcatcacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcttagctaattaataagcactacatccatgcatgtccacaatagggccctagccctactatactatacgtcgtcagcagaaagtctggttttgatttcaataataagatgcacctatatgtgtgtgttacatgtaaaaaaaaaaaaa

SEQ ID NO: 40624 - protein, 116 aa, Zea mays
  misc_feature: Ceres CLONE 1433858-F
  misc_feature (1)..(93): Pfam Name: GRP Pfam Description: Glycine rich protein family
MASKRLLVLVALLLAAVFLAVSGAANDDQAQPRKDDGGENKADVQDYRGGGGGWRGGGGYPGRGYPGGGGYPGGGRGGYCRWGCCNRGYYGGCRCCSRADEVPEPMYRPEPTEVHN

SEQ ID NO: 40625 - DNA, 706 bp, Zea mays
  misc_feature: Ceres CLONE 1433863-F
  misc_feature: Encodes the peptide sequence at SEQ ID NO. 40626
  misc_feature (645)..(645): n is a, c, t, g, unknown, or other
ggagctccccgcggtggcggccgctctagaactagtggatcccccgggctgcaggaattcgcacgagaccattacctagaacatcctaatcgaaaaaacggtcccctcctcctcctcctcctccgctctcctctccccaaagtaataactagtaaacagagctgcgtccaggcttcttcgatcggtccatggctgtcgtcacgagggacgcggcgtgcctgcccctcgtcctcctgctcctagtcttctccgcggccccgtctccggctgacggctgcgaccgctgcgtgcgccggtccaaggccacctactaccaggcctcctcgctcgccctcaacgccgggtcgtgcgggtacggctccttggccgcgtccctcaacggcggcctgctcgccgcagccagccccgagctgtacaggggcggcgtcggctgcggcgcctgcttccaggtgcggtgcagggacagcgagctgtgcagcgccgccggcggcaaggtggtggtgactgaccaggcgcggacgtcaaaccgcacggcgctggtgctgagcgccgcggcgtacgcggccatggccagtgccggcaaggccgcgccgcctcaggaaccgggccgtcgtcgacttccaggacaagaaggtaccccctgcnaagtacgcgaaaggaccgcaaccctgttgaataccccgtgtcagaaaaaacaaccccgccc

SEQ ID NO: 40626 - protein, 172 aa, Zea mays
  misc_feature: Ceres CLONE 1433863-F
  misc_feature (68)..(138): Pfam Name: DPBB_1 Pfam Description: Rare lipoprotein A (RlpA)-like double-psi beta-barrel
  misc_feature (153)..(153): Xaa is any aa, unknown, or other
MAVVTRDAACLPLVLLLLVFSAAPSPADGCDRCVRRSKATYYQASSLALNAGSCGYGSLAASLNGGLLAAASPELYRGGVGCGACFQVRCRDSELCSAAGGKVVVTDQARTSNRTALVLSAAAYAAMASAGKAAPPQEPGRRRLPGQEGTPCXVRERTATLLNTPCQKKQPR

SEQ ID NO: 40627 - DNA, 764 bp, Zea mays
  misc_feature: Ceres CLONE 1433870-F
  misc_feature (259)..(259): n is a, c, t, g, unknown, or other
  misc_feature (421)..(421): n is a, c, t, g, unknown, or other
aaagctggagctccccgcggtggcggccgctctagaactagtggatcccccgggctgcaggaattcgcacgagaccattacctagaacatcctaatcgaaaaacgagcaaaccctagcgagcgagagagcccggagccgagagaccagccagccatggcgctgcgtgccctgtacaacgagatccggagcatgaaggtccgcgacgtgccggcttacctgaagccgcgcttgtcccgggtcaagaagagcgacgaccangacgtcgaccgctacatcgagaagtacatcgacatgagctcgacggaccttgtctatcacgtctgcatcggaaggaggatcttcatctacttccgacatccgccctgggaggggggaccccttcgcccaccttcaacaaaaggaaaaggaccgggggaaaanataaaatccggtgccccgtccccccccggggcgggggaaggggggggaacttttagggggccccttcccggggaaggggtttgttttttttttctttttggaactaagggaatcaggaatttttggccctggggtttttccccccccccgaaagaaacgccccctttttttttttgtcccccccccccccccaaaaaaacaccaaaaaaaaggggggggggggtgggggtaaaaaatttttctcgctggggggaaaaaatttttttttttttttttattttttctccccacccacccttatttttgttgtggggggggaaaaaaaaaaaaaaaatatttttta

SEQ ID NO: 40628 - DNA, 597 bp, Zea mays
  misc_feature: Ceres CLONE 1433871-F
  misc_feature: Encodes the peptide sequence at SEQ ID NO. 40629
  misc_feature (243)..(243): n is a, c, t, g, unknown, or other
  misc_feature (246)..(246): n is a, c, t, g, unknown, or other
  misc_feature (356)..(356): n is a, c, t, g, unknown, or other
  misc_feature (431)..(431): n is a, c, t, g, unknown, or other
  misc_feature (540)..(540): n is a, c, t, g, unknown, or other
aagctggagctccccgcggtggcggccgctctagaactagtggatcccccgggctgcaggaattcgcacgagaccattacctagaacatcctaatcgaaaagtcgatcaatactactacacagtaggaagctaggaggaaatcaaagcaacaaagttgccggccgagagaaccaaaccatgaggcctcaggtgttactcgtcacactggctgttatcgtcgtccttgcagctctgccactcancanagggacggaggaggaagacggaggggcggtagtcgccgccgtggacgacgccggaacgagctcgtggccatgctgcgacaagtgcggtttctgctacctgtcttacccgncgcagtgccaatgcctggacttctcgacggtcgggtgccacccagagtgcaagcagtgcatcaagtacaccgccngacgatggcgtcaacatcccccccgtgcacgcctaacggttgccccaaattcctttgtaaatttggggaggggcggttccttcccccccgagttggttatgattttttngcgcttgccccaagtaaaaaaaagggggctgggccctccccccaaagcccttttggg

SEQ ID NO: 40629 - protein, 139 aa, Zea mays
  misc_feature: Ceres CLONE 1433871-F
  misc_feature (22)..(22): Xaa is any aa, unknown, or other
  misc_feature (23)..(23): Xaa is any aa, unknown, or other
  misc_feature (60)..(60): Xaa is any aa, unknown, or other
  misc_feature (85)..(85): Xaa is any aa, unknown, or other
  misc_feature (121)..(121): Xaa is any aa, unknown, or other
MRPQVLLVTLAVIVVLAALPLXXGTEEEDGGAVVAAVDDAGTSSWPCCDKCGFCYLSYPXQCQCLDFSTVGCHPECKQCIKYTAXRWRQHPPRARLTVAPNSFVNLGRGGSFPPELVMIFXRLPQVKKRGLGPPPKALL

SEQ ID NO: 40630 - DNA, 747 bp, Zea mays
  misc_feature: Ceres CLONE 1433886-F
  misc_feature: Encodes the peptide sequence at SEQ ID NO. 40631
ggagctccccgcggtggcggccgctctagaactagtggatcccccgggctgcaggaattcgcacgagaccattacctagaacatcctaatcgaaaacttcaattccggaatgggcatgccgcgagcacgacccttggcctgcattgccgtggcggccattgcgctcctcgcgccgacgcgcggagcggagatggtcgagcggcagttcgtggagtgggtgcgctacatgggcggcctccggcacagcacgttccagcagcacgcgctgggacgcgcgtccccctcgtactcgctcgtcgtcgacgccaacccggggttcgaaacttccccaccatccaggccgccgtccactccctccccaagacttgaacctgggccgcgtccttattaagggtcacccccggccccctaccgggaaaaggggagcctttcggggaaagcccgcgttttctcccccctgagagggccccccgcccaaaaacacaaattcttgagggggggggaaccccccgaaattccccaaagggggggaaaggggaagcccccccccggacaattaaaaactccggtgctttttcccggggaaaaccccgctattttttgtgggggggaaaattcttttttttaaaaaaaccttcccctctttatataaaaccccggggtaatagaaaaaaaaagagggggggccccctcctttttgccccccaaaaaaccacccctttcggggggagggacttcctccgcgcc

SEQ ID NO: 40631 - protein, 93 aa, Zea mays
  misc_feature: Ceres CLONE 1433886-F
MGMPRARPLACIAVAAIALLAPTRGAEMVERQFVEWVRYMGGLRHSTFQQHALGRASPSYSLVVDANPGFETSPPSRPPSTPSPRLEPGPRPY

SEQ ID NO: 40632 - DNA, 689 bp, Zea mays
  misc_feature: Ceres CLONE 1433896-F
  misc_feature: Encodes the peptide sequence at SEQ ID NO. 40633
ctccccgcggtggcggccgctctagaactagtggatcccccgggctgcaggaattcgcacgagaccattacctagaacatcctaatcgaaaaacgccgccagtcacgaccacgccgcgcctccgcctggaaccctttagccgagcggagcaagggaagaaatggggaagggtacgggcagcttcggcaagcgccggaacaagacgcacacgctctgcatccgctgcggccgccgcagcttccacctccagaagagcacctgctcctcctgcggctaccccgccgcccgcatccgcaagtataactggagtgtgaaagccatcaggcgtaagacaactggtaccggaaggatgaggtacatgcgacacgttcctcgcccgttttcagagcacttcagagaagggactgaggctgccccaaagaaggtggtgctgctgccaactaagtgtggtcttgctgccatcaagaagtgctagacttgagacttttttgatggattggacttctgaaccctttaccccaaaaaacatgcttgaatttaattcccaacgcccctgaaagggaagaaaggatccttttggggaaaaaaaaaaaaaaaaaaatttttccaaccccccacccccgagggggggccgggaaccccatctccccaaaaggggggcaaatatcccccccccccgggggccgttt

SEQ ID NO: 40633 - protein, 104 aa, Zea mays
  misc_feature: Ceres CLONE 1433896-F
  misc_feature (2)..(55): Pfam Name: Ribosomal_L37e Pfam Description: Ribosomal protein L37e
MGKGTGSFGKRRNKTHTLCIRCGRRSFHLQKSTCSSCGYPAARIRKYNWSVKAIRRKTTGTGRMRYMRHVPRPFSEHFREGTEAAPKKVVLLPTKCGLAAIKKC

SEQ ID NO: 40634 - DNA, 766 bp, Zea mays
  misc_feature: Ceres CLONE 1433914-F
  misc_feature (216)..(216): n is a, c, t, g, unknown, or other
  misc_feature (310)..(310): n is a, c, t, g, unknown, or other
  misc_feature (311)..(311): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (711)..(711): n is a, c, t, g, unknown, or other
  misc_feature (712)..(712): n is a, c, t, g, unknown, or other
  misc_feature (718)..(718): n is a, c, t, g, unknown, or other
  misc_feature (719)..(719): n is a, c, t, g, unknown, or other
tggagctccccgcggtggcggccgctctagaactagtggatcccccgggctgcaggaattcgcacgagaccattacctagaacatcctaatcgaaaaaagagatcgaggctcctatctggtataggacggagctgagcttctagcaacgtacagtgtatccgccatgagtcctttcggggcggtgatcacgccagagacccctcagtacatgtccnagtacccaggacgtgagatcacgcaggtggactgcgcacgggaggcgatgaagctgatccacccgaaggacaggaaccttcaggccaggactcnncgtgggaccctaaaaaaagatccgcaaacgggtgagccccattggccttgtttaaaaacccccggggcccggctgaaccttgggaaaaacggaaaaaaagggggggttctctttaaattttccaaatccgggaactttttaaagggggggggggtgtttctttccccggaaaaaccccttttttggggggaaacacccccccccgtgttttcccccgggggggaaaaaggggggccaaaaatttttccccccgcgggggggcccgggggggagaacacccccccccttttttgttgtggggggggaaaaattccccaccgccgggggggggggggcgcaaaaaactttttttttttataagggcccccccccccacaaaaaaaaaaannnngtttttttnngggggnnaaaataatttttttttttttttaacccaaaccaccgcgcgcgggggc

SEQ ID NO: 40635 - DNA, 746 bp, Zea mays
  misc_feature: Ceres CLONE 1433928-F
  misc_feature: Encodes the peptide sequence at SEQ ID NO. 40636
  misc_feature (296)..(296): n is a, c, t, g, unknown, or other
  misc_feature (310)..(310): n is a, c, t, g, unknown, or other
ccccgcggtggcggccgctctagaactagtggattccccgggctgcaggaattcgcacgagaccattacctagaacatcctaatcgaaaatataccgcgggtaggcggactgggcggctgacggagccgcggagggaaccgagtggccccggcgacgcgaggccgaggcgagctaatctgacggtggcagtgacgactccaacgaccaggcgcggaggctgcactgctccagcgaaggcaccatgtcattcatgtctccatttccggggatgggatctagtaaaatggatcccggnactctgaccctccnttgggcagctgggtgtgtaatgctgactatgcatttcactgtgcaattggggtcacaacatcctcttctattggaaaacccccagggagccaaagccttttcttatttatggggctggaggctccccttaaaccctatcttttcctttggggggttttctggaatccccggggaaacaaaaattttttccactttttaaaaggctttaaaaaaagtttttagggccctggggtttttccaaattttggggggtttgggcccccctttcttaattttttttcccccaaaaaatttcccctgtaaaaaaaaggggggggggggcacaaaacccccccgcgggttttttttctccccccccccgttttgtgtggggccacaaaattattttcctttgagggggggcgccccctttttttttttttggggccgccctctt

SEQ ID NO: 40636 - protein, 88 aa, Zea mays
  misc_feature: Ceres CLONE 1433928-F
  misc_feature (23)..(23): Xaa is any aa, unknown, or other
MSFMSPFPGMGSSKMDPGTLTLXWAAGCVMLTMHFTVQLGSQHPLLLENPQGAKAFSYLWGWRLPLNPIFSFGGFSGIPGETKIFSTF

SEQ ID NO: 40637 - DNA, 678 bp, Zea mays
  misc_feature: Ceres CLONE 1433933-F
  misc_feature: Encodes the peptide sequence at SEQ ID NO. 40638
  misc_feature (476)..(476): n is a, c, t, g, unknown, or other
tccccgcggtggcggccgctctagaactagtggatcccccgggctgcaggaattcgcacgagaccattacctggaacatcctaatcgaaaatcctctgcttctggcgaccaaattctgccgtctccaccgccgccgcagccagcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttccccacgacgccgaggttgcgcgctancagcacaagcttcattgaggatccagctccatgccgtctctcttttcgcaaacgtttcgcctggtcctttcctggatccgtgttaacttcagtactttatctgggcactcaagggcctggataaataaaaatggatgttgttcccggttaagaggatcaaggaaacaatccctcatcttaaggttgttggaaagaatccgcc

SEQ ID NO: 40638 - protein, 103 aa, Zea mays
  misc_feature: Ceres CLONE 1433933-F
  misc_feature (98)..(98): Xaa is any aa, unknown, or other
MNTDITASTKPEYPVVDRNPAFTKVVGNFSALDYMRLSTISAVSVTVGYLSGIKPGIRGPSMVTGGLIGVMGGFMYAYQNSAGRLMGFFPHDAEVARXQHKLH

SEQ ID NO: 40639 - DNA, 825 bp, Zea mays
  misc_feature: Ceres CLONE 1433952-F
  misc_feature: Encodes the peptide sequence at SEQ ID NO. 40640
ggagctccccgcggtggcggccgctcttcactagtggatcccccgggctgcaggaattcgcacgagaccattacctagaacatcctaatcgaaaaacgactgaggagcaaccaatccacccaaatccccgaccgagctgcgatcctcaacgccgccagtcgcgccgcctcagatggccggggggcgcgggccccatgtcatcaagatccacgatcccaacctgcccctcctctgcagggcgccggggactgcaccgtgcgccatccccgcgccgtcccgcgatgagggcatcctcctggagtaccctcgcagcagcccccttgaggacatccgaacccgcacccgggccttttacccttatctcgcaaccgcgtgggggggggggggaacaagcaaatttcagtaagtgtcccccacccaaaaagaaaaaggtgttctcgggcaaaccaaatttcgggggtttaacccaccatttttttttggcggggaaaataaaaaaattttcgggggggggctcccgtttcttgaaaacacctggggtgctccccccacaagggggaaagctccggtggggagaaccgccttgctacaaccccccccccccaatatatttaacacaaaaaacccgtttcctcttgcaccccacaaatcgccggcgaggtggtctaccttttttgctccaaaattacttctcggtgttctcccgcggggcggggggtatccttttttcacaggcgctcaccgagtaatgggggatgagtcctcgccaaaataggggccgcgccgtatgtatacataagtggtggcgcgcaaatataataatca

SEQ ID NO: 40640 - protein, 77 aa, Zea mays
  misc_feature: Ceres CLONE 1433952-F
MAGGRGPHVIKIHDPNLPLLCRAPGTAPCAIPAPSRDEGILLEYPRSSPLEDIRTRTRAFYPYLATAWGGGGTSKFQ

SEQ ID NO: 40641 - DNA, 623 bp, Zea mays
  misc_feature: Ceres CLONE 1433966-F
  misc_feature (237)..(237): n is a, c, t, g, unknown, or other
  misc_feature (249)..(249): n is a, c, t, g, unknown, or other
  misc_feature (255)..(255): n is a, c, t, g, unknown, or other
  misc_feature (260)..(260): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (478)..(478): n is a, c, t, g, unknown, or other
  misc_feature (479)..(479): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (535)..(535): n is a, c, t, g, unknown, or other
  misc_feature (537)..(537): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaaatcacctataatattttgagcattcagaaacacaccaagcgaagcgcactagcaacaacctaacaacaatggctaccaagatattatccctccttgcgcttcttgcgctttttggcgaaagcggcaacaaatgcgtccanttattccacaangggctncaccntggggcccccaattcacttatccccaagccccccccccattatttaaagggccttaaaacccccgtggggggaccctttggggttaaaaaaaaaattttttttgggcggggaagggggtgtttttaaaaaaaaaaaaaaaagttggccgcagggaaaaaaaaaactggggggggggaaaaaaaaaaaaaaaaaaannncccccccccccccccccccnnaaacacacaaaaaaaaaaaaaaaaaannnnnnntgtgagaaggcgagggggggggncncccccnnnnnnnccgggnnngnnnnnnaggagaaagaggagggccgcccccctccctttatataaaaaaaaaaaagaaccggtggg

SEQ ID NO: 40642 - DNA, 684 bp, Zea mays
  misc_feature: Ceres CLONE 1433970-F
  misc_feature: Translation starting site: 166
tggagctccccgcggtggcggccgctctattgctaatggatcccgcgggcgtgcaggaattctcaccataccattacctacaacatactaatcaaaaatcaaccatattattgagactaacaagcaacatacaaagtgtaatcctctacttactatacatcatcaatggctaccaatatattttctcctccttatgctgcgttgctctgttctgcgtgtgttgctaacgcgacaattttccctcaatgctcacgaggtcatatagattaccttcttcgcgcatacgtatccatcaatgatagcttcagtatgtgaaaacgcagctcttcaaccctatatgctcacaacaactatctcagcaagcaacttacctttatcatcgttgtttcactatcgccaggcctatctattggtgcactgcatggtacagacgatcaggtacagcagctgtagcaagtgctgctagctgagatcaactagtagctctggcaaacctttctccctactctcagcacaaggattacatgcagtcacccaactgctaagtgaaacgggctgcttatttggaagaacaagtattagctttaagcctcgtagcactggctaactccaagaaaaaacacttcctcaaataaacaaattgtgcgagttgaaccccggtttttaatttggggagaaaaagaa

SEQ ID NO: 40643 - DNA, 701 bp, Zea mays
  misc_feature: Ceres CLONE 1433979-F
  misc_feature: Encodes the peptide sequence at SEQ ID NO. 40644
  misc_feature (370)..(370): n is a, c, t, g, unknown, or other
  misc_feature (371)..(371): n is a, c, t, g, unknown, or other
  misc_feature (394)..(394): n is a, c, t, g, unknown, or other
  misc_feature (397)..(397): n is a, c, t, g, unknown, or other
  misc_feature (398)..(398): n is a, c, t, g, unknown, or other
  misc_feature (416)..(416): n is a, c, t, g, unknown, or other
tggagctccccgcggtggcggccgctctagaactagtggatcccccgggctgcaggaattcgcacgagaccattacctagaacatcctaatcgaaaaacacggcttttggcagctacaaaccacccaaaagccacccccagaaaccggcggtccttgggtgttccggatctgagccagcagctgagaagaggatgagcgccgtggccgccatggcgacgtcgtcgctgaaccccaacgcgccgctcttcatcccggcggcgtaccggcaggtggaggaatttctcgcagagtggtacgagctcgtcaacaccaccgcctgtttcccgggacactggttccccgcagcacagcaccacgaggccgtcttcnnccgcgcggacgccgagttcgaantcnnccgcgctcctttcccgangactccgtcgacttcctcgaaaccggagaactttttttaggcggcgtgaagtccaccccccccccaaagccaaagcggggctggttgcccgggtaaaacccccaaatgttcgggggggtgaagcttatttccccccgggggcggccccgccccttcccttttttttttttcgccccccccaaaaaaggaccccggaagggggggggccccccccggggggggggcgcgcccccgttttttctccaccccctcttttaaaaaaaacccataataagggggggcccc

SEQ ID NO: 40644 - protein, 87 aa, Zea mays
  misc_feature: Ceres CLONE 1433979-F
  misc_feature (60)..(60): Xaa is any aa, unknown, or other
  misc_feature (68)..(68): Xaa is any aa, unknown, or other
  misc_feature (69)..(69): Xaa is any aa, unknown, or other
  misc_feature (75)..(75): Xaa is any aa, unknown, or other
MSAVAAMATSSLNPNAPLFIPAAYRQVEEFLAEWYELVNTTACFPGHWFPAAQHHEAVFXRADAEFEXXRAPFPXTPSTSSKPENFF

SEQ ID NO: 40645 - DNA, 677 bp, Zea mays
  misc_feature: Ceres CLONE 1433997-F
  misc_feature: Encodes the peptide sequence at SEQ ID NO. 40646
  misc_feature (531)..(531): n is a, c, t, g, unknown, or other
  misc_feature (537)..(537): n is a, c, t, g, unknown, or other
  misc_feature (542)..(542): n is a, c, t, g, unknown, or other
  misc_feature (544)..(544): n is a, c, t, g, unknown, or other
  misc_feature (579)..(579): n is a, c, t, g, unknown, or other
  misc_feature (580)..(580): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctcagcaacaacaatttncttcanttcancnactgtctacactgaaccctgctgcttatttgcagnncacactattaccatttagccagntagctactgcctacttctcaaaaaaacactttcttcatttaaaccaatggccgacctgaaccccgctgcttatt

SEQ ID NO: 40646 - protein, 163 aa, Zea mays
  misc_feature: Ceres CLONE 1433997-F
  misc_feature (121)..(121): Xaa is any aa, unknown, or other
  misc_feature (123)..(123): Xaa is any aa, unknown, or other
  misc_feature (124)..(124): Xaa is any aa, unknown, or other
  misc_feature (125)..(125): Xaa is any aa, unknown, or other
  misc_feature (137)..(137): Xaa is any aa, unknown, or other
  misc_feature (145)..(145): Xaa is any aa, unknown, or other
METKIFSLLMLLALSTCVANATIFPQCSQAPIASLFPPYLPSIIASVCENPALQPYRLQQAIAASNIPLSPLLCQQSPALSLVQSLVQTIRAQQLQQLVLPVINQVALANLSPYSQQQQFXSXXXLSTLNPAAYLQXTLLPFSQXATAYFSKKHFLHLNQWPT

SEQ ID NO: 40647 - DNA, 631 bp, Zea mays
  misc_feature: Ceres CLONE 1433998-F
  misc_feature: Encodes the peptide sequence at SEQ ID NO. 40648
  misc_feature (602)..(602): n is a, c, t, g, unknown, or other
tggcggccgctcttgaactagtggatcccccgggctgcaggaattcgcacgagaccattacctagaacatcctaatcgaaaaaaattctattactagctgcaaaagggcgtgtttgagactagcggaccgaccttgaagttgaagttgaaaaggtcggcctgcgcggcgatggatgtcaagtgccggcgtctggaggggaaggtggccatcttgactgcgtccacgatggggatcggcctcgccatcgccgagcgcctcggtctggagggcgccgccgtcgtcatctcctcccgcaagcataacaacgtgaacgaggcggtggacgggctcaaggccaagggtatcaccgcggttggtgccgtctgccacgtctccgacgcacagcatcacacgagcctcatcgagaccgccgtccagagctttgggcacatagatattcttgtctccaatgctgccgcaaatccttctgtagatagcatacttgaaatcgaaggatctgttctcgataagctgtgtgatcatgacgtcaaggcttctatccttcttattcaggatgctgctcctccctacggtacggggcatcggggaatattacttcctncatttgccgggtaccaatccgaaacaagg

SEQ ID NO: 40648 - protein, 154 aa, Zea mays
  misc_feature: Ceres CLONE 1433998-F
  misc_feature: SWISSPROT Homolog: EC 1.1.1.184 Carbonyl reductase (NADPH)
  misc_feature (145)..(145): Xaa is any aa, unknown, or other
MDVKCRRLEGKVAILTASTMGIGLAIAERLGLEGAAVVISSRKHNNVNEAVDGLKAKGITAVGAVCHVSDAQHHTSLIETAVQSFGHIDILVSNAAANPSVDSILEIEGSVLDKLCDHDVKASILLIQDAAPPYGTGHRGILLPXFAGYQSETR

SEQ ID NO: 40649 - DNA, 537 bp, Zea mays
  misc_feature: Ceres CLONE 1434001-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (106)..(106): n is a, c, t, g, unknown, or other
  misc_feature (182)..(182): n is a, c, t, g, unknown, or other
  misc_feature (309)..(309): n is a, c, t, g, unknown, or other
  misc_feature (334)..(334): n is a, c, t, g, unknown, or other
  misc_feature (343)..(343): n is a, c, t, g, unknown, or other
  misc_feature (368)..(368): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggagctccacgncggtggcggccgctctagaatagtggatcccccgggctgcaggaattcgcacgagaccattacctagaacatcctnaatcgaaaaacagtctcaccacagcgagcgagagcaaggcgccccaagcaaccaccgcgagaacaagtcgcagccaaacagcccccgtctcccagcgaagcttgagcttgcattattctaccatgtnctccatggagctgctccacgcgtcntccggaaancaaacgaggagaagtcgcgccgcancgacgacacgagcagaccgcaccgcacgggggggacaaggcgccccctgcccaaggggtggccaaaaagaaaccctcgccccccccgcgattggagagagaaaaacccccgcttttcccccctaggggttccccgggggggcccccccccgtgttgggggcccccaaac

SEQ ID NO: 40650 - DNA, 638 bp, Zea mays
  misc_feature: Ceres CLONE 1434003-F
  misc_feature: Encodes the peptide sequence at SEQ ID NO. 40651
  misc_feature (41)..(41): n is a, c, t, g, unknown, or other
  misc_feature (251)..(251): n is a, c, t, g, unknown, or other
  misc_feature (353)..(353): n is a, c, t, g, unknown, or other
  misc_feature (355)..(355): n is a, c, t, g, unknown, or other
  misc_feature (357)..(357): n is a, c, t, g, unknown, or other
  misc_feature (363)..(363): n is a, c, t, g, unknown, or other
  misc_feature (407)..(407): n is a, c, t, g, unknown, or other
  misc_feature (414)..(414): n is a, c, t, g, unknown, or other
  misc_feature (462)..(462): n is a, c, t, g, unknown, or other
  misc_feature (464)..(464): n is a, c, t, g, unknown, or other
  misc_feature (471)..(471): n is a, c, t, g, unknown, or other
  misc_feature (500)..(500): n is a, c, t, g, unknown, or other
  misc_feature (515)..(515): n is a, c, t, g, unknown, or other
  misc_feature (523)..(523): n is a, c, t, g, unknown, or other
  misc_feature (537)..(537): n is a, c, t, g, unknown, or other
  misc_feature (553)..(553): n is a, c, t, g, unknown, or other
  misc_feature (558)..(558): n is a, c, t, g, unknown, or other
  misc_feature (564)..(564): n is a, c, t, g, unknown, or other
  misc_feature (580)..(580): n is a, c, t, g, unknown, or other
tccccgcggtggcggccgctctagaactagtggatcccccngggctgcaggaattcgcacgagaccattacctagaacatcctaatcgaaaacagtgcaaacaagctcgctcgcaagcgcaacccacccacgtctacggtctaccacacgaagcatcgtagccagccagccagctaaacccacaccacacatggccgggatcgtggtggtgttcgacttcgacaagacgatcatcgacgtggacagcgacnactgggtggtggacagcctcggcctcaccgacctgttcgagcgcctcctccccaccacgccctgaaacacgctcatggacacaatgatgggggagctgcacncncngggcangaccctggccgaggtgaccgaggcgctcagggcggcgcccatcnacccccncgtgccccccgccgtcagggccgcgcacgccctccgctgcaacctgcncntgctcancgacgccaacgccttcttcatccacaccntcctgaaccaccacngcctgctnccctgcttctccangtcaacaccaacccanccgcntcaacncccacggccgactccncatcgggccctgccacgacccgcgcgcggcgccgcacggctgcggcgtcggcagctgg

SEQ ID NO: 40651 - protein, 41 aa, Zea mays
  misc_feature: Ceres CLONE 1434003-F
  misc_feature (21)..(21): Xaa is any aa, unknown, or other
MAGIVVVFDFDKTIIDVDSDXWVVDSLGLTDLFERLLPTTP

SEQ ID NO: 40652 - DNA, 650 bp, Zea mays
  misc_feature: Ceres CLONE 1434009-F
ggagctccccgcggtggcggccgctctagaactagtggatcccccgggctgcaggaattcgcacgagaccattacctagaacatcctaatcgaaaaatcaccaccactgggtcttcagaccattagctttatctactccagagcgcataataacccgatcgacaccatgagggtgttgctcgttgccctcgctctcctggctctcgctgcgagcgccacctccacgcatacaagcggcggctgcggctgccagccaccgccgccggttcatctaccgccgccagtgcatctgccacctccggttcacctgccacctccggtgcatctcccaccgccggtccacctgccggcgccggtccacctgccacctcctgaccatgtgccgccgcctgttcatctgccgcctcctccatgccatctaccctactcaaccgccccggcctcatcctcatccccagccacacccatgcccgtgccgacaaccgcatccaaccccgtgccaactgcaaggaacctgcagcgttggcaacacccccatcctgggacaatacgtccagttcctgacgaatccatgcaatccgacggatactccctactgctctcctcaaagccagtcgatgctgcagcaggataccaccaactcatgtcag

SEQ ID NO: 40653 - DNA, 651 bp, Zea mays
  misc_feature: Ceres CLONE 1434020-F
  misc_feature: Encodes the peptide sequence at SEQ ID NO. 40654
tccccgcggtggcggccgctctagaactagtggatcccccgggctgcaggaattcgcacgagaccattacctagaacatcctaatcgaaaaagcaaatctcgtgggcgtgtagcgtccgccacctgcgtccgcgcctttccatttccaccccgatcgcgttttccggccccgccgcctgtccctgcgctagtcgacactcgacaggctcggtttccgccctcccctcccaccgccgcgcaccgagaagatggggaagcggtggatcccgctggaggccaacccggacgtcctgaaccagttcatatgggggctgggagtccacgaggaggatgtgcagttctgcgacgtctacggccttgacgatgagctgctcgctatggtgccccagcccgttctcgccgtcctcttcctctacccgctcacctccctggacgaggagaaagaagaatcaagtgtttctgctgccacatcgacctcagcgggcaaggaattgagcaagaaggtatactttacgaagcagactgttggtaatgcttgtggaacagttggtgttattcatgcaattggaaatgcaacatctcaaatcaagctagttgaggggtcctattttgagaagttctataagcaaacggctgatatggatccagctc

SEQ ID NO: 40654 - protein, 134 aa, Zea mays
  misc_feature: Ceres CLONE 1434020-F
  misc_feature (4)..(134): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
MGKRWIPLEANPDVLNQFIWGLGVHEEDVQFCDVYGLDDELLAMVPQPVLAVLFLYPLTSLDEEKEESSVSAATSTSAGKELSKKVYFTKQTVGNACGTVGVIHAIGNATSQIKLVEGSYFEKFYKQTADMDPA

SEQ ID NO: 40655 - DNA, 641 bp, Zea mays
  misc_feature: Ceres CLONE 1434032-F
tggagctccccgcggtggcggccgctctagaactagtggatcccccgggctgcaggaattcgcacgagaccatacctagaacatcctaatcgaaaaagatctagcgccgcctccttcaccctgctgctggccgcctggccggcgagctcctcagcgtggaagaagacaaaaaacgttatagtgaagaggaggggttgattgctgcattcaaaagtgtcggggataccttatccaatgctactgagaaggttgccacaggggacactgatgtgccagatgatctttttatagtttgataaacctttcaggttttgagcagacccacatatctctgtatttcaattatctggtggcgcaccctcacattgctagagccttcaagaagttgtcattcgaccacaagttaatctgggctcgcaatttcgtcagtgaaaagttcctaggagtgtgagggcagttggtaggtaggcttggagggttcttttgcttgaaccacattgaacaatgaactgcgatctatgtgtaaccaggagtgtgagggcagttagtagataggcttggacggttcttttgcttgaactacatcaaacaatgaaatgtcgtctaagtatgtcagcggattttgcttgaacatgcagatt

SEQ ID NO: 40656 - DNA, 621 bp, Zea mays
  misc_feature: Ceres CLONE 1434041-F
  misc_feature: Encodes the peptide sequence at SEQ ID NO. 40657
  misc_feature (349)..(349): n is a, c, t, g, unknown, or other
  misc_feature (382)..(382): n is a, c, t, g, unknown, or other
ggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggacccgcaggaggacctgcggtggtgcaagcaggcgtgcgagtggcantacggaaaggacaccccgcggagagggaatgcnagagcgagtgccgcgagcggcaccagcaagctgacgcgggcgaagacggcgacagcggcgtgaaccgctacgtctcccgctcccggaggggcgagtgcccggcccaagtgcctggcgcccccccgaggggccaggcgtggggagacccaggaatgcatgaggcggtggccccccccccggactggccctcaaaatggaacaagaataccggtcccggaaaccaaaaccccggggcaaat

SEQ ID NO: 40657 - protein, 83 aa, Zea mays
  misc_feature: Ceres CLONE 1434041-F
  misc_feature (52)..(52): Xaa is any aa, unknown, or other
MGKGSVGASWWAFLLLAGVLLVVAATAGAEDGVVERDPQEDLRWCKQACEWXYGKDTPRRGNARASAASGTSKLTRAKTATAA

SEQ ID NO: 40658 - DNA, 642 bp, Zea mays
  misc_feature: Ceres CLONE 1434047-F
  misc_feature: Encodes the peptide sequence at SEQ ID NO. 40659
  misc_feature (545)..(545): n is a, c, t, g, unknown, or other
  misc_feature (554)..(554): n is a, c, t, g, unknown, or other
  misc_feature (569)..(569): n is a, c, t, g, unknown, or other
aaagctggagctccccgcggtggcggccgctctagaactagtggatcccccgggctgcaggaattcgcacgagaccattacctagaacatcctaatcaaaaaacacacaaacacatcagcattcagcagtagctaatcgagcatcgtcgccttagctcctctcctcttctctccgtcgtcgtggaacttctctccgccggctgccatataaaggagaagaagagaacagcaacgctagctagtcggccggcctccatcgccgccggcgtcgactagctagctaactctcgatctccagttcctgccccccaactccgtcgtcagcgatggcaggaggcctcttctccatggctcacccggccatcaccctctccggcatcgcaggaaacatcatctccttccctgtgttccttgcaccagtggcgacgttcctgcaggtgtaccgagaggcgtcgacgggcagggtcagctcggtgccgtacgtggtggcgctcttcagctcggtgctgtggatcttctacgcgctggtgaagacaactcgaggncgctgctgnaccatcacgccttcngctgcggcgtggaggcggcctacatagtcctctacctggcgtacgcgccgcggcgtgcgcgcctgctgactct

SEQ ID NO: 40659 - protein, 89 aa, Zea mays
  misc_feature: Ceres CLONE 1434047-F
  misc_feature (14)..(83): Pfam Name: MtN3_slv Pfam Description: MtN3/saliva family
  misc_feature (76)..(76): Xaa is any aa, unknown, or other
MAGGLFSMAHPAITLSGIAGNIISFPVFLAPVATFLQVYREASTGRVSSVPYVVALFSSVLWIFYALVKTTRGRCXTITPSAAAWRRPT

SEQ ID NO: 40660 - DNA, 657 bp, Zea mays
  misc_feature: Ceres CLONE 1434071-F
  misc_feature: Encodes the peptide sequence at SEQ ID NO. 40661
gctctagaactagtggatcccccgggctgcaggaattcgcacgagaccattacctagaacatcctaatcgaaaagatagtgagcgacgccacgggacaggcatggcgagccgcgagcggcagcacacccgcagctacgactacgactacgagcacctcgtgctcgacccggcgtctctgggcgtgccgtgggccgacccggccgccgtggagatcccgccgcagctcctcgccgcgctcggggagtacctctccggctccgcggcccgcggggacgtcgaggcggacgcggacgacgagttcatgatgcacgagttcaaggtgcggccgtgcgcgcgcgcctcggacccccgactgggacggggttgcccctacttcgcacgcggggcgagggcctcgcgggcgtccgggtaccgttgtcggggtctgtctacgacggggggaattcgtgccccggtagtttcgggcctccacccctggtggttatttatcagctgcgccgccccttctgggggcactgcctggaccgcctcggggaatggtaccgtatccaagtgctgactctcgccgcgttgccgctgaccttatatcaaaccttggttgttgtcgggcgcctcgcctggctgtccacctgacgtgtgctatttctccttgccac

SEQ ID NO: 40661 - protein, 152 aa, Zea mays
  misc_feature: Ceres CLONE 1434071-F
MASRERQHTRSYDYDYEHLVLDPASLGVPWADPAAVEIPPQLLAALGEYLSGSAARGDVEADADDEFMMHEFKVRPCARASDPRLGRGCPYFARGARASRASGYRCRGLSTTGGIRAPVVSGLHPWWLFISCAAPSGGTAWTASGNGTVSKC

SEQ ID NO: 40662 - DNA, 646 bp, Zea mays
  misc_feature: Ceres CLONE 1434075-F
  misc_feature: Encodes the peptide sequence at SEQ ID NO. 40663
aaagctggagctccccgcggtggcggccgctctagaactagtggatcccccgggctgcaggaattcgcacgagaccattacctagaacatcctaatcgaaaaaaaaacaggcaatgggcaacgcataggcatagcttggctcgcacggtgtcgctggctcccctccccttccctccccactgtaacatccagagagctgttcacggccgtgccgagctcagtgaggcagcgtttgcgagtccgggacgaggggagcggcttgcgacatgcggaggggcctcaacgagataaagcggatcgagaaccccacgcagcggcagtccaccttctacaagcgcaaggacggcctcttcaagaaggctagggagctctcctttctgtgcgacgtggacctgctgctgctcctcttctccacctccgggaagctctaccactatctctcgcccatcgtcccctccataaagggacctggtcgagaggtactaggccacgacgcacaccaaggtctggaccgacatccaccaaagagcggcgcgcggagcttggaaaagggggagcataatgtgcgagctgatggaaaaaagagcttgcgggccatgaccggtggacgacggggcagcaataacgcgggagccgttcacctgga

SEQ ID NO: 40663 - protein, 126 aa, Zea mays
  misc_feature: Ceres CLONE 1434075-F
  misc_feature (9)..(59): Pfam Name: SRF-TF Pfam Description: SRF-type transcription factor (DNA-binding and dimerisation domain)
MRRGLNEIKRIENPTQRQSTFYKRKDGLFKKARELSFLCDVDLLLLLFSTSGKLYHYLSPIVPSIKGPGREVLGHDAHQGLDRHPPKSGARSLEKGEHNVRADGKKSLRAMTGGRRGSNNAGAVHL

SEQ ID NO: 40664 - DNA, 626 bp, Zea mays
  misc_feature: Ceres CLONE 1434087-F
  misc_feature: Translation starting site: 233
  misc_feature: SWISSPROT Homolog: EC 1.15.1.1 Superoxide dismutase
aaagctggagctccccgcggtggcggccgctctagaactagtggatcccccgggctgcaggaattcgcacgagaccattacctagaacatcctaatcgaaaaatcctcgcttcaggtctgcagcccccaactacccccagcctcggaaggaaccttccagaagcgcaagactctaaggccgtcaccttcccattcttcctcgccgcgggggtcgcctgagatcacataaacaatggtgaaggctgttgctgtgcttggtagcagtgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggtgtttattcttcttttactttggcttgcttatgtgatcagggtgtgtgctaagttaatattggccattgaactttctacttgttggtgaaatcaaggaccacactacaatcctgcgagcaaggagcatggggcaccagaagatgagaaccgccatgccggtgatcttggaaatgtgacagctggagcagatggtgttgctaatatcaatgtcact

SEQ ID NO: 40665 - DNA, 837 bp, Zea mays
  misc_feature: Ceres CLONE 1434090-F
  misc_feature (19)..(19): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (770)..(770): n is a, c, t, g, unknown, or other
tcgttttgttttttttttnccttcggcgggccgggcgggtggggggtggggtgtgggggagtggtgtggnnnttcttnnnnnttatactggggctccccgcggtggcggccgctctatactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggcctccctctacatctgatccagctaagtagctagccagcactacagaagggcgtggcaagaatcaggagagagatagcaggggggctagctagctgagctcgtgcgacgaaagaatggccggaattgggaggaacatggtggcggccgctccgtgggggggggggggcctcaatcatgcacatccatccggcattcgggtttcgcgaggctggaaacctggaacccactttctttcaacgggggaaaaccaaactacccccgggcggggggccggggaacccggccccagaccgtgcctaacttcccgggggggtggggccaatccttggccatgtgcggggggggggcggccgggcgttccaaacccttgggggggggcgtggcttaccaactgtggtgtccgcctgtgggggcccaaggaacaagccgtgtggccgcaccaaacgggccggcagncttggtgggttggcggcctgaggggtgggggcaatgcacccgacgcggttgcagccgctcccggagg

SEQ ID NO: 40666 - DNA, 656 bp, Zea mays
  misc_feature: Ceres CLONE 1434106-F
  misc_feature: Encodes the peptide sequence at SEQ ID NO. 40667
  misc_feature (460)..(460): n is a, c, t, g, unknown, or other
  misc_feature (561)..(561): n is a, c, t, g, unknown, or other
aaagctggagctccccgcggtggcggccgctctagaactagtggatcccccgggctgcaggaattcgcacgagaccattacctagaacatcctaatcgaaaaacaactccacaagatctagaacctaagaacctgcggaggagaggaagaggagcttggggaggagatggccggcgccgagggcgagaggtgggtggggctagcaacggacttctcggaggggagccgggcggcgctgcggtgggcggcggccaacctgctgcgagccggcgaccacctgctgctgctgcacgtcatcaaggagcccgactacgagcagagcgaggccatcctctgggaatccaccggctccccgttgattcccctctcggaattctctgaccctatcattgcgaagaaatatgggagcaagccggacatagaaaccttggacatcctgaacactacagctacccagaangatatcgtggtggttgtgaaagtcctggtgggtgatccgcgtgagaagctctgttcagttatccatgataccccgctgagctgcttggttataggaagcanggggcttggcaaagctcagagggtggctctggggagtgtcagcgactatgttgtgaaacatgcgacctgccctgtcaccgtcagtcagtcaacag

SEQ ID NO: 40667 - protein, 163 aa, Zea mays
  misc_feature: Ceres CLONE 1434106-F
  misc_feature (6)..(161): Pfam Name: Usp Pfam Description: Universal stress protein family
  misc_feature (98)..(98): Xaa is any aa, unknown, or other
  misc_feature (132)..(132): Xaa is any aa, unknown, or other
MAGAEGERWVGLATDFSEGSRAALRWAAANLLRAGDHLLLLHVIKEPDYEQSEAILWESTGSPLIPLSEFSDPIIAKKYGSKPDIETLDILNTTATQXDIVVVVKVLVGDPREKLCSVIHDTPLSCLVIGSXGLGKAQRVALGSVSDYVVKHATCPVTVSQST

SEQ ID NO: 40668 - DNA, 670 bp, Zea mays
  misc_feature: Ceres CLONE 1434129-F
  misc_feature: Encodes the peptide sequence at SEQ ID NO. 40669
aaagctggagctccccgcggtggcggccgctctagaactagtggatcccccgggctgcaggaattcgcacgagaccattacctagaacatcctaatcgaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatatttgtgacacattccgtctacaggagcaacctcctttttgacagaaatcatttgtgtcttacatcaaaaatacatcaagaatctcactggctgtgttggagccagagaaagccgatgaattcaaaaagggtgtcgagggtggaacccaattttctccttaccaggctgagggacctccatttttttgttggtggagccataaagaaagaagcgtctgggggaattcccccttttaaaggggagggggcccataaatccaaaattcccctatttttcccccaggggggta

SEQ ID NO: 40669 - protein, 81 aa, Zea mays
  misc_feature: Ceres CLONE 1434129-F
  misc_feature (1)..(82): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDICDTFRLQEQPPF

SEQ ID NO: 40670 - DNA, 622 bp, Zea mays
  misc_feature: Ceres CLONE 1434131-F
  misc_feature: Encodes the peptide sequence at SEQ ID NO. 40671
  misc_feature (439)..(439): n is a, c, t, g, unknown, or other
  misc_feature (567)..(567): n is a, c, t, g, unknown, or other
aagctggagctccccgcggtggcggccgctctagaactagtggatcccccgggctgcaggaattcgcacgagaccattacctagaacatcctaatcgaaaacaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactactctactcaaacgcgcggncctcagcctcatcccaggcacacccatgcccgtgccaacagccgcaatcaagcccgtgccagctgcagggaacctgcggggttgggagcaccccaatctggggcaatgcgtcgagattctgaggaatnaggggagcccgacggaaccccgtactgttcgctcagggccagtctttcagaacat

SEQ ID NO: 40671 - protein, 52 aa, Zea mays
  misc_feature: Ceres CLONE 1434131-F
  misc_feature (35)..(35): Xaa is any aa, unknown, or other
MPVPTAAIKPVPAAGNLRGWEHPNLGQCVEILRNXGSPTEPRTVRSGPVFQN

SEQ ID NO: 40672 - DNA, 668 bp, Zea mays
  misc_feature: Ceres CLONE 1434132-F
  misc_feature: Encodes the peptide sequence at SEQ ID NO. 40673
aaagctggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgctttttagaat

SEQ ID NO: 40673 - protein, 118 aa, Zea mays; identical to SEQ ID NO: 12523
  misc_feature: Ceres CLONE 1434132-F
  misc_feature (13)..(116): Pfam Name: MAP1_LC3 Pfam Description: Microtubule associated protein 1A/1B, light chain 3

SEQ ID NO: 40674 - DNA, 647 bp, Zea mays
  misc_feature: Ceres CLONE 1434150-F
  misc_feature: Encodes the peptide sequence at SEQ ID NO. 40675
  misc_feature (467)..(467): n is a, c, t, g, unknown, or other
  misc_feature (477)..(477): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaacccgtccctctcccacccttttcagatctgcctgcgagcccccgccacgcacccccatgcccatgcggccatgcccatgaccccccgacgcgaggccactactgccaatggctccctgccgtgaccgagcccatggaggacctcgccccgggggccctcgcactcttcgccgccgtcgctgacttcatagacgactccgctcctgctgccgccggggccgggatgccaccgccggagcccgagtccgcgcccgggagtccctgctccgactgcagcagcgtcgccaccgccgacttcgagggcttcgccgacctcgcctccacgctcgtgctcgacgacctcgtctcccccgcctccccgctccngctcagcagntcgctccccgcctcggggccagggccgcaggagcgtcttcncgctcgactgcgtgccgcgctggggactccactcgtggtgcggcgaacgccggagaggaagacgccgccgggtgctcccaactttcttcacgtcccgtctggatgctcgcggggaaccgccgtcaacgc

SEQ ID NO: 40675 - protein, 137 aa, Zea mays
  misc_feature: Ceres CLONE 1434150-F
  misc_feature (78)..(78): Xaa is any aa, unknown, or other
  misc_feature (81)..(81): Xaa is any aa, unknown, or other
  misc_feature (95)..(95): Xaa is any aa, unknown, or other
MEDLAPGALALFAAVADFIDDSAPAAAGAGMPPPEPESAPGSPCSDCSSVATADFEGFADLASTLVLDDLVSPASPLXLSXSLPASGPGPQERLXARLRAALGTPLVVRRTPERKTPPGAPNFLHVPSGCSRGTAVN

SEQ ID NO: 40676 - DNA, 653 bp, Zea mays
  misc_feature: Ceres CLONE 1434152-F
  misc_feature: Translation starting site: 193
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
tggagctccccgcggtggcggccgctctagaactagtggatcccccgggctgcaggaattcgcacgagacnnntacctagaacatcttaatcgaaaaatctatcgcactcgtagtcgtagctcaagcatcagcggcaggagctctgggcagcgtgcgcacgtggggtacctagctcgctctgcnnnnctaccatggctgatcaccaccggggtgcgacgggaggtggcgggggctacggcgacctccagcgcgggggcggcatgcacggcgaggcgcagcagcagcagaagcnnngcgccatgatgacggcgctcaaggccgcgacggccgcgaccttcggcgggtcgatgctggtgctgtccgggctgatcctggccggcaccgtgatcgcgctcacggtggccaccccnnngctggtgatcttcagcccggtgctggtgccggccgccatcgcgctggcgctcatggcggccgggttcgtcacctccggcggcctcggcgtcgctgcgctgtccgtgttctcctggatgtnnnttatctgacgggcaagcacccgccgggcgccgaccagctggaccacgccaaggcgaggctggcgtccaaggcccgcgacatcaaggatgcagcacagcaccgcatcgaccaggcgcag

SEQ ID NO: 40677 - DNA, 666 bp, Zea mays
  misc_feature: Ceres CLONE 1434161-F
  misc_feature: Encodes the peptide sequence at SEQ ID NO. 40678
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
aagctggagctccccgcggtggcggccgctctagaactagtggatcccccgggctgcaggaattcgcacgagaccattacctagaacatcctaatcgaaaaacaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgccnnnnacacccgcaagcgcgtcgtcggcgtcctcctcggcacctcatcccgcgggtccgtcgatgtcaccaactcctacgccgtgccgtttgaggaggatgacaaggatcctaggatctggttccttgaccacaattaccannnntcaatgttctccatgttcaagaggattaatgccaaggagcatgttgttggctggtacagcactggcccaaaactaagggagaacgacttggatgtccatgcattattcaacagttatgttcnnnntccagtcttggtgattattgatgtccaacccaaggagctgggtataccgaccaaagcgtactacgctgtggaggaggttaaagagaatgcaactc

SEQ ID NO: 40678 - protein, 156 aa, Zea mays
  misc_feature: Ceres CLONE 1434161-F
  misc_feature (12)..(125): Pfam Name: Mov34 Pfam Description: Mov34/MPN/PAD-1 family
  misc_feature (36)..(36): Xaa is any aa, unknown, or other
  misc_feature (37)..(37): Xaa is any aa, unknown, or other
  misc_feature (82)..(82): Xaa is any aa, unknown, or other
  misc_feature (83)..(83): Xaa is any aa, unknown, or other
  misc_feature (124)..(124): Xaa is any aa, unknown, or other
  misc_feature (125)..(125): Xaa is any aa, unknown, or other
MDVVKAAQLSGRTLERVVVHPLVLLSIVDHYNRVAXXTRKRVVGVLLGTSSRGSVDVTNSYAVPFEEDDKDPRIWFLDHNYXXSMFSMFKRINAKEHVVGWYSTGPKLRENDLDVHALFNSYVXXPVLVIIDVQPKELGIPTKAYYAVEEVKENAT

SEQ ID NO: 40679 - DNA, 631 bp, Zea mays
  misc_feature: Ceres CLONE 1434168-F
  misc_feature: Translation starting site: 211
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
ggagctccccgcggtggcggccgctctagaactagtggatcccccgggctgcaggaattcgcacgagaccattacctagaacatcctnnncgaaaaaaccctttcatattaactttgtctgtatctctctttcatttgtgttcttgtttggggttcatcatatacaacagtgggtatttctgcttcctacacttattttttgctggagaaatggtcctccnnncttccatcgatgtactccgcagactcggagcttccaacgatggtcgcgaggtcatgcgtccaacagtcaactttattcttcaaagcatttggtacggaccataccgacccaagtacttatgtccattctcatataacacaccttctgtacctaaccggtgaatactccgtagactacagctgggacaccttcggtctctccactgaccctgaaacctttgctcataaccgagagttctaaattctccacaatagatgaggcatgctatgcttctttaaactgcatcttcctagagattctcttcaaaaactgagtcaaattcggtgaaagcttgatgtatcatgcaggatctctgatcttctcagaatgaggacttgactacctcaggaaacctatatcgatgcacga

SEQ ID NO: 40680 - DNA, 646 bp, Zea mays
  misc_feature: Ceres CLONE 1434178-F
  misc_feature: Encodes the peptide sequence at SEQ ID NO. 40681
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (621)..(621): n is a, c, t, g, unknown, or other
  misc_feature (622)..(622): n is a, c, t, g, unknown, or other
tccccgcggtggcggccgctctagaactagtggatcccccgggctgcgggaattcgcacgagaccattacctagaacatcctaatcgaaaaactggcatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgnnncgtaaacgcgcagcagcacttcgacccggtcggccacggcctgcccctaggcgttgacatccagatccatctcgctccgatctacattcgagnnnnttgtctccgacatcgattccccagtctgaatcgttgtcgacgtcttctttgggtggacggtcgaagtcacgcgcacgcacatccnnnncttgttcctccccggcggtgcattcagcaacactgtcttcttctccgtgtcggagcacctcgggccacaggggcggacccgtgaacgacggggnntcagagtgtcacgatctccggacg

SEQ ID NO: 40681 - protein, 33 aa, Zea mays
  misc_feature: Ceres CLONE 1434178-F
MFASRTHHLLNNVQTANHNILLHSPTSHTFQLG

SEQ ID NO: 40682 - DNA, 643 bp, Zea mays
  misc_feature: Ceres CLONE 1434182-F
  misc_feature: Encodes the peptide sequence at SEQ ID NO. 40683
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaaacgcctaggagctattctctctagtactgcggcgacttcactccaagcctcccccttcagcgatcagcacacatcacgtaaagcgcaaccaaatgatttccaccaccgtcgctgctcaccccgccaccgtcacagcgctgcggcgaaggtacccgcttcgccctcgccagccactctgtgctccaatcttcacggcggcgacgaggcagtgcatggctacggcgaagccctcggtcacaaacgcgnnnnctaacctatccgttgagagcgcccccgcggcgcttcccaagctttcgttcccgatactggtgaatagttgcactgggaaaatggggaaggnnnntgctgaagcagctgtctcggctggtcttcagttagttcctgtatcattcagtgccattgaggtccctgatcgaaagattgaaannnntgatagagaaatttttattcatgacccatctgaaagtgaaaaaattctgcctaccattgttaaagaatacccaaatgtcatagttgtagannnnactgtgcctgatgctgttaatgc

SEQ ID NO: 40683 - protein, 111 aa, Zea mays
  misc_feature: Ceres CLONE 1434182-F
  misc_feature: SWISSPROT Homolog: EC 1.3.1.26 Dihydrodipicolinate reductase
  misc_feature (12)..(12): Xaa is any aa, unknown, or other
  misc_feature (13)..(13): Xaa is any aa, unknown, or other
  misc_feature (43)..(43): Xaa is any aa, unknown, or other
  misc_feature (44)..(44): Xaa is any aa, unknown, or other
  misc_feature (72)..(72): Xaa is any aa, unknown, or other
  misc_feature (73)..(73): Xaa is any aa, unknown, or other
  misc_feature (103)..(103): Xaa is any aa, unknown, or other
  misc_feature (104)..(104): Xaa is any aa, unknown, or other
MATAKPSVTNAXXNLSVESAPAALPKLSFPILVNSCTGKMGKXXAEAAVSAGLQLVPVSFSAIEVPDRKIEXXDREIFIHDPSESEKILPTIVKEYPNVIVVXXTVPDAVN

SEQ ID NO: 40684 - DNA, 599 bp, Zea mays
  misc_feature: Ceres CLONE 1434189-F
  misc_feature: Encodes the peptide sequence at SEQ ID NO. 40685
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (322)..(322): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (386)..(386): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
tggagctcaccgcggtggcggccgctctaaactagtggatcccccgggctgcgggnnntcgcacgagaccattacctagaacatcctaatcgaaaacagccctcgtccaggcgcgcggccaccgcatcgagaccgtcccagagatgcccctggtcatctccgacnnngcggagtccatcgagaagacctcccaggcgctaaagatcctcaagcaggtcggcgcctacgccgacgccgagaaggccaggactcgtcggcatccgnnnggcaaggtaagatgcgcaccggcgctacataaacgcagggcccgctcgtcgttacnggacagagggctccaggtcgtcaaggcttccggcacctccccgggggggggnnnggcgaagttnaggggctcaacctgctcaactcgcccgcggggggccacctggggggttttgggattggaaccaaaagcccttcaaaaacctcagggggggatggggacttgggnnnaggggtccaaaaaaaaaaagggttttttttcccgaggccccaaaggcccacccttacccggggggaatttccacctcaaaaggggcccctggggttaacccccccaa

SEQ ID NO: 40685 - protein, 148 aa, Zea mays
  misc_feature: Ceres CLONE 1434189-F
  misc_feature (8)..(8): Xaa is any aa, unknown, or other
  misc_feature (41)..(41): Xaa is any aa, unknown, or other
  misc_feature (60)..(60): Xaa is any aa, unknown, or other
  misc_feature (78)..(78): Xaa is any aa, unknown, or other
  misc_feature (81)..(81): Xaa is any aa, unknown, or other
  misc_feature (116)..(116): Xaa is any aa, unknown, or other
  misc_feature (117)..(117): Xaa is any aa, unknown, or other
MPLVISDXAESIEKTSQALKILKQVGAYADAEKARTRRHPXGKVRCAPALHKRRARSSLXDRGLQVVKASGTSPGGGXAKXRGSTCSTRPRGATWGVLGLEPKALQKPQGGMGTWXXGSKKKKGFFSRGPKGPPLPGGNFHLKRGPWG

SEQ ID NO: 40686 - DNA, 659 bp, Zea mays
  misc_feature: Ceres CLONE 1434199-F
  misc_feature: Encodes the peptide sequence at SEQ ID NO. 40687
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (414)..(414): n is a, c, t, g, unknown, or other
  misc_feature (415)..(415): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
aaagctggagctccccgcggtggcggccgctctagaactagtggatcccccgggctgcaggaattcgcacgnnnccattacctagaacatcctaatcgaaaaacacattccgcgcacaccccggcagccgcaaacgccttcgccgtcgcgtcccgctcctccgcccgcccgacgcgacccctaggnnntggagagagaggtcggcatggctgccgcagtggtcgacgacgctggtatggacgccgtccagaagcgcctcatgttcgaagacgaatgcattttggtggacgagcnnnacaatgttgttggccatgagtcaaagtacaactgccatttgatggaaaagattgattctgagaatctgctacatagggcattcagtgtgttccttttcaactcaaaatatgagctggnncttcagcaaaggtccgcgacaaaggttacctttcctttagtttggaccaatacctgctgcagccaccctctgtaccgtgagtctgagcttatccaggagaactaccttggtgtgagaaatgcnnnncagaggaagctactggatgagctgggcatcccagcagaagatgccccagttgaccaattcacccctctgggccgaatgctttacaaggcaccatctgacgggaaatggggggagcatg

SEQ ID NO: 40687 - protein, 151 aa, Zea mays
  misc_feature: Ceres CLONE 1434199-F
  misc_feature: SWISSPROT Homolog: EC 5.3.3.2 Isopentenyl-diphosphate Delta-isomerase
  misc_feature (30)..(30): Xaa is any aa, unknown, or other
  misc_feature (31)..(31): Xaa is any aa, unknown, or other
  misc_feature (70)..(70): Xaa is any aa, unknown, or other
  misc_feature (112)..(112): Xaa is any aa, unknown, or other
MAAAVVDDAGMDAVQKRLMFEDECILVDEXXNVVGHESKYNCHLMEKIDSENLLHRAFSVFLFNSKYELXLQQRSATKVTFPLVWTNTCCSHPLYRESELIQENYLGVRNAXQRKLLDELGIPAEDAPVDQFTPLGRMLYKAPSDGKWGEH

SEQ ID NO: 40688 - DNA, 753 bp, Zea mays
  misc_feature: Ceres CLONE 1434205-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (400)..(400): n is a, c, t, g, unknown, or other
  misc_feature (402)..(402): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (438)..(438): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttnnnnnnnnnnnnnnnnnnnnnnnnnnnnnnnnnnnnnnnnnnnnnnnnnnnccaaactgggactcaccgcggtggcggccgctctagactagtggaacccccgggctgcaggaattcgcacgagaccattacctagaacatcctaatcgaacaatcaactcgcaatttcgcattcgtccaaactcttgagcactttctcctcgtccccgacaagccactcgaaagcgaaatacggccatggactccaccngncaccgggagcacgnnnggaagggaaaagaagggagncggcccgggcgcaaggttcgggcgggccaaggaagaagtcccgtgtcaaggtcccttgaaggcctgggctccaattcccccgttcggccgaatcgggggcnnnttttaagaaaaggcccccttacccccaaagttgtttggaacacgggggccccccctttttaccttgccgggttttgccctcaaaaaaacctctccccccctaaaaatttcttggnnntgtcccccccggaaaaattttttccccccgggaaaaaacaannnngaaaaaaaaatcctccccctttttttttcttccccccccccccgatggtt

SEQ ID NO: 40689 - DNA, 675 bp, Zea mays
  misc_feature: Ceres CLONE 1434207-F
  misc_feature: Encodes the peptide sequence at SEQ ID NO. 40690
aagctggagctccccgcggtggcggccgctctagtctagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgtgaaagttttgacagcatgggactgcaagagaaccttctgagaggcatctatgcctatggttttgagaagccatcggctattcagcaaaggggaatagttcccttctgcaaggggcttgacgtgattcagcaagctcagtctggaactggaaaaacagctaccttctgttctgggatcttgcaccaacttgattatggattggttgaatgccaggcattggttcttgctcccacccgggagcttgctcaccaaattgagaaggctatgcgtgcccttggggactatttgggtgtcaaacagcatgcccggtgttggggaaacatctggtccgggagga

SEQ ID NO: 40690 - protein, 148 aa, Zea mays
  misc_feature: Ceres CLONE 1434207-F
MAGLAPEGSQFDDKQYDKKMQEILTEDFFTSYDDVCESFDSMGLQENLLRGIYAYGFEKPSAIQQRGIVPFCKGLDVIQQAQSGTGKTATFCSGILHQLDYGLVECQALVLAPTRELAHQIEKAMRALGDYLGVKQHARCWGNIWSGR

SEQ ID NO: 40691 - DNA, 662 bp, Zea mays
  misc_feature: Ceres CLONE 1434208-F
  misc_feature: Encodes the peptide sequence at SEQ ID NO. 40692
  misc_feature (524)..(524): n is a, c, t, g, unknown, or other
  misc_feature (554)..(554): n is a, c, t, g, unknown, or other
  misc_feature (632)..(632): n is a, c, t, g, unknown, or other
ctccccgcggtggcggccgctctagaactagtggatcccccgggctgcaggaattcgcacgagaccattacctggaacatcctaatcgaaaaagtcgaccgccgcagaccgggagtagtcgacgcgccgtcactgaatcctcagatcacggctagccgtaatcacgccactctgctgactcccggcgagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaagtatcacaattgatattgctttgtggaagttcgagaccaccaagtactactgcactgtcattgatgcccctggacaccgtgacttcatcaagaatatgattactggcacttcccaagctgactgncgctgtcttatcattgactccactactggntggttttgaggctggtatctccaaggatggacagacccgcgagcatgctctccttgctttcacgcttggagtgaagcnaatgatttggctgtgcaacagatggatgcc

SEQ ID NO: 40692 - protein, 123 aa, Zea mays
  misc_feature: Ceres CLONE 1434208-F
  misc_feature (5)..(124): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (111)..(111): Xaa is any aa, unknown, or other
MGKEKTHINIVVIGHVDSGKSTTTGHLIYKLGGIDKRVIERFEKEAAEMNKRSFKYAWVLDKLKAERERSITIDIALWKFETTKYYCTVIDAPGHRDFIKNMITGTSQADXRCLIIDSTTGWF

SEQ ID NO: 40693 - DNA, 924 bp, Zea mays
  misc_feature: Ceres CLONE 1434209-R
  misc_feature: SWISSPROT Homolog: EC 3.5.2.3 Dihydroorotase
cgattgggtaccgggccccccctcgaggtcgacggtatcgataagcttttttttttttttttttagcaaaaacataaaaatattatttctcggactaaaaggttatccggctatgtaactgaaaggctgatatttattcattacattattagggatgtggcaacatgtttcaaaggttaggggtccaagcatacccagttggccttggggaaaaatagcaccttgggccatctaggcgtccaaaaaacctcaactcttgccgggacgccttgtccccttaaaaaccacaaatgttatggtgtctaaatcagaaaactagccttgataaacatacaaaagggccttttacctacttccaaaattgcactgcaatgcaaatggatataacaactcaacaagcggaacctccccctttgctttcaacaagcaaaaaagtttccctatcctgattccagtggaaacgggaaaaagaacaagaaaactccacctatggattcccccaagtgcagggcccaaaaacccatacggtttactctttaggctaaccaaatgcaacccattcaagggtgctgccactaaacataggcacaatctcccctgaactgggtttataagtagcaggaactttccgggtattctttctcagaaaatttttgaagtgttccttgggaggccaaaaaaatccgggcccattgagcttgtaaatgctttttgtttaacaaggggaccagccccttcaaaaaaccttcccaaaaggaaacagggcaacagggagcccttattatttccagcacactccccggggaacccttctttttctcccttaaatcagggggaagcgctttcttcttaaccaaggagaggaccgcgccaaccctcacttttgttaaaagcagaaaacaaataaaccttgttctattaaat

SEQ ID NO: 40694 - DNA, 534 bp, Zea mays
  misc_feature: Ceres CLONE 1434209-F
ctggagctccccgcggtggcggccgctctagaactagtggatcccccgggctgcaggaattcgcacgagaccattacctagaacatcctaatcgaaaaactcctcatcgccacaagtgaagtcaccgacgcacgcacggctgcagcgcgctcctactctcccgcgaccgccaccggggaggggcaatagaatatagcgaggacagccaatgcaggccgccgtcaacaccaccactgtcggcgctcacccgcacccacaaagtctcgttcctcgtcatccctcctgcgcgtctacttcacgcttctcacgcccgaacataggcgatcgccatgccagcaatcgcagctgcaggagcactgatcatcactcgcccaacgactggcacctcatctcccaaagcgggtctctcagctgaatgcccccacccaggcttttgggaggcatctcatgcccaactgaacccgcgggaaccaaaggcccgggccatggataagggggggaaaaatgaggggccccccccccggaaaaccttcc

SEQ ID NO: 40695 - DNA, 686 bp, Zea mays
  misc_feature: Ceres CLONE 1434211-F
  misc_feature: Encodes the peptide sequence at SEQ ID NO. 40696
  misc_feature (470)..(470): n is a, c, t, g, unknown, or other
  misc_feature (528)..(528): n is a, c, t, g, unknown, or other
  misc_feature (544)..(544): n is a, c, t, g, unknown, or other
agagctggagctccccgcggtggcggccgctctagtactagtggatcccccgggctgcaggaattcgcacgagaccattacctagaacatcctaatcgaaaaaatgtcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggtaaaacctcccccgcgctccggccatgcgccggcgccgcagccgcttgccatcgagcagccatggctcacgatcgacgctctgtgtgtctgcgtgcgtggtttgcaggcgacggaggggatgaacgtgaaggaggagtgccagcgctggttcatggagatgaactggaagaaggtgcaccgcttcgtggtgtacaagatcgacgagcggncgcgcgccgtgctggtggacaaggtgggcggccccggggaagggtacgaggagctcgnggccgcgctgcccggngacgactgccgctaccccgtcttcgacttcgacttcgtcaccgtcgaacactggccgaagagcaagatcttcttcatcgcctggtcacccggcggcgtccaggatcagggccaaaatcctgtacgcgacattcaagccagga

SEQ ID NO: 40696 - protein, 149 aa, Zea mays
  misc_feature: Ceres CLONE 1434211-F
  misc_feature (52)..(149): Pfam Name: Cofilin_ADF Pfam Description: Cofilin/tropomyosin-type actin-binding protein
  misc_feature (78)..(78): Xaa is any aa, unknown, or other
  misc_feature (97)..(97): Xaa is any aa, unknown, or other
MAMAYKMVKPPPRSGHAPAPQPLAIEQPWLTIDALCVCVRGLQATEGMNVKEECQRWFMEMNWKKVHRFVVYKIDERXRAVLVDKVGGPGEGYEELXAALPGDDCRYPVFDFDFVTVEHWPKSKIFFIAWSPGGVQDQGQNPVRDIQAR

SEQ ID NO: 40697 - DNA, 699 bp, Zea mays
  misc_feature: Ceres CLONE 1434214-F
  misc_feature: Encodes the peptide sequence at SEQ ID NO. 40698
aaagctggagctccccgcggtggcggccgctctagaactagtggatcccccgggctgcaggaattcgcacgagaccattacctagaacatcctaatcgaaaaaggattttgtttcgggtgaggtggggggcggcatggcgccacccgccgctcaggctcagctcctcctctccaaccacccctcgccgttgctgtcgccgccgcaacgtcgtcgcctcctcggtggaccgccgcctcgctcacacacctgcgccatccggcaccaccacggccacgacaagtgcgcctcctcctcctccactcgccttcgccacgccctccgcccgcccgccgccaccgccgtggccatcgcgcccggcgaccactggggaaactgggccttcctcctctccgccgccgcgttcggcacatgggcggaggacaacacgtcgtggggcgccgcgctcagcggcgcgctggttagcatcatggccggcctggctgccacggccgtcggcctcgtcaccccccggggcgcccgcgcacgacgccgtcatggagtaactgctgccggccgccgtcccgctgctactcctcgggcgccacctcccgcgcgtcgtccgcaccaccggcggacctccctcaaggcattcctgctccggatctgttggcaactgtaaatccgcaacaacgggtgggcctatttggctgaacccccat

SEQ ID NO: 40698 - protein, 174 aa, Zea mays
  misc_feature: Ceres CLONE 1434214-F
MAPPAAQAQLLLSNHPSPLLSPPQRRRLLGGPPPRSHTCAIRHHHGHDKCASSSSTRLRHALRPPAATAVAIAPGDHWGNWAFLLSAAAFGTWAEDNTSWGAALSGALVSIMAGLAATAVGLVTPRGARARRRHGVTAAGRRPAATPRAPPPARRPHHRRTSLKAFLLRICWQL

SEQ ID NO: 40699 - DNA, 663 bp, Zea mays
  misc_feature: Ceres CLONE 1434217-F
  misc_feature: Encodes the peptide sequence at SEQ ID NO. 40700
  misc_feature (421)..(421): n is a, c, t, g, unknown, or other
aaagctggagctcaccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacaaacnccttccagcgccgcgccgcccaactcctggccgacctcccggcagccgacgacgtcctctccctcgcctggacgcgccgcctcctcgaatccttcctcctctgcctcgaggagttccgcgccctgctcttcggctccggggactcgcccgctgctcggcccccgctcgaccgcctcgtcgccgacttctccgaccgcgccgtcaaggggctcgacctctgcgaacgcctccgcaacggcctc

SEQ ID NO: 40700 - protein, 128 aa, Zea mays
  misc_feature: Ceres CLONE 1434217-F
  misc_feature (48)..(48): Xaa is any aa, unknown, or other
MPATDSSSSSSSSPAAAPLSSIGRSIRSLRRDQNQIHSFPPPPDATNXFQRRAAQLLADLPAADDVLSLAWTRRLLESFLLCLEEFRALLFGSGDSPAARPPLDRLVADFSDRAVKGLDLCERLRNGL

SEQ ID NO: 40701 - DNA, 669 bp, Zea mays
  misc_feature: Ceres CLONE 1434221-F
  misc_feature: Encodes the peptide sequence at SEQ ID NO. 40702
  misc_feature (553)..(553): n is a, c, t, g, unknown, or other
ctccccgcggtggcggccgctctagaactagtggatcccccgggctgcaggaattcgcacgagaccattacctagaacatcctaatcgaaaaacagtgcctctcgctcactgactgactgtaataccagagatcgaacaacttggtcctgcagctcaagaagagagtttttgtgcatttgggggccgggggcaagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcaccgccatcacggaggccgacctaaacaagattgagccatgggacctccctagcaaggcgaagatgggcgagaaagagtggtacttcttctaccagaaggaccgcaagtacccgacggggctgagggcgaaccgggccaccgaggcctgttactggaaggcgacggggcaagacaaggaggtctancacgccgcggaaggggtggcggtactggtcagcatgaagaagacgctcgtcttctacaggggcaggcctcccaggggtgacaagacaaactgggtcatgcacgagtacaggctcga

SEQ ID NO: 40702 - protein, 152 aa, Zea mays
  misc_feature: Ceres CLONE 1434221-F
  misc_feature (23)..(152): Pfam Name: NAM Pfam Description: No apical meristem (NAM) protein
  misc_feature (114)..(114): Xaa is any aa, unknown, or other
MAADQQPQLQEEMNDAAGGGLRLPPGFRFHPSDFEIVSFYLTNKVLNTRFTCTAITEADLNKIEPWDLPSKAKMGEKEWYFFYQKDRKYPTGLRANRATEACYWKATGQDKEVXHAAEGVAVLVSMKKTLVFYRGRPPRGDKTNWVMHEYRL

SEQ ID NO: 40703 - DNA, 685 bp, Zea mays
  misc_feature: Ceres CLONE 1434228-F
  misc_feature: Encodes the peptide sequence at SEQ ID NO. 40704
  misc_feature (585)..(585): n is a, c, t, g, unknown, or other
aactggagctccccgcggtggcggccgctctagtctagtggatcccccgggctgcaggaattcgcacgagaccattacctagaacatcctaatcgaaaaatcatacctcgaacgctccgacaaaaacatctagggccccgtgctcttggctcgtgaaatggcggcacctgtaccggatgccagagctgtgaaccgtaaccccatctcggactcccaagttgctggtttattgacagtccgacacccctgcctccatgggcagcctggatctatactcgagatatcatcacgccacggtgatcaagctcatgaggtactactacttggcattggggaccctcgtcctgcgttatcattctggtttcctcatctcgcccaccatggaccgtgaagaaagtgcacccaacgaagcgattcccatccttgaacagtaccatgcaaatgggtgtggtcctgaccaagctccaactgtgtgatactcaaacatggtgttaagaaagacaaatctgtgctcaaccgcatctggacaattagaagatgcactcacgaatgggaatactagcactgtttcaaactcaattggtngcactagacacacaagctctccccagactaaggcgactgacagtgctgaaacggcttgaaatgtctcactggttaagctatcaagaagggctttgctctt

SEQ ID NO: 40704 - protein, 73 aa, Zea mays
  misc_feature: Ceres CLONE 1434228-F
MGSLDLYSRYHHATVIKLMRYYYLALGTLVLRYHSGFLISPTMDREESAPNEAIPILEQYHANGCGPDQAPTV

SEQ ID NO: 40705 - DNA, 920 bp, Zea mays
  misc_feature: Ceres CLONE 1434231-R
cgattgggtacggggccccccctcgaggtcgatggtatcgataagcttttttttttttttttttatccaatggttcaaatattcaaattctttgaaaaactcaccacaaacttttaaatgttaagatattcaatttcttcgaaaatgttcagactttagacaaaaggtaactctaatatgggggcttcccacacccaggggggacaactcaaaaactgagtgggcaaaaaacttaacacggtcaaaaagttaaagcttatggggaagcattaaccggtgctgaacctggagctttagcagcaccaccaggaccagggcgggggcctccttgtccaccagggggcctatcctccttgcgcaatgaagcgttccgggggattgcggtcccagcgcttcaacgggaaccgcacccccacgatgtgagcggggaacgcgcaccaaactccttgttgcaccttgacgtacagaattcgggaggacaaacccaccaaagagacacgcttcctggaggtcccaaaaggccgcctgttccactattttccccacctgaaaacctctcgatcccctgggccttggggcaaaacttggcccaatttgccccccagaaggttttttaaggggaccggggcccttcctgggattcccccccccccaccggtggagcccccgttttttgttccccttagagaaaggctaattaattgcaatcttttaaaagggttttaacgttagaaaggggacaccggccttttaaaaaactttccacaatagaagaacagggcccccgggccctataaaatatcccgcaacatccccgaggaacccttttttgcgcccggtaagacggagggggggagctgttgtttccccagggagtagcccccacctttctccttttggacagatataaacaaaagagt

SEQ ID NO: 40706 - DNA, 624 bp, Zea mays
  misc_feature: Ceres CLONE 1434235-F
  misc_feature: Encodes the peptide sequence at SEQ ID NO. 40707
aagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgctttcctcacgccctgcctctggctcttcctctgcctcctcgctgcgccgtgcccccgcgcgcgggcggcgcggttcgcgtgcaacgccacggcgccgcgagcgtccacgtgcccagcgctcgtctcctacgcgccggcccaacgggacggccacgccccacctggcccccgtggggggggctttttcagtttccgctccaacggggggttggtgggcgccaaaagggctcccggttttcaaggcggcccaagg

SEQ ID NO: 40707 - protein, 90 aa, Zea mays
  misc_feature: Ceres CLONE 1434235-F
MAPLPAFLTPCLWLFLCLLAAPCPRARAARFACNATAPRASTCPALVSYAPAQRDGHAPPGPRGGGFFSFRSNGGLVGAKRAPGFQGGPR

SEQ ID NO: 40708 - DNA, 589 bp, Zea mays
  misc_feature: Ceres CLONE 1434242-F
  misc_feature (231)..(231): n is a, c, t, g, unknown, or other
  misc_feature (232)..(232): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (541)..(541): n is a, c, t, g, unknown, or other
  misc_feature (564)..(564): n is a, c, t, g, unknown, or other
aagctggagctccccgcggtggcggccgctctagaactagtggatcccccgggctgcaggaattcgcacgagaccattacctagaacatcctaatcgaaaaaaaatttctcctctcgaagaaccctagcggcaaaacctttgctccgtcccgccgtcgcctgctcccatcccgccgccggcgctgccacccgcatctgccaaggggctcgccgccgggggaggctgcttcnncggtggcnnngttcttttcccgggggccggaaactttggggcccctccccccccctcccttaaattttgccaaaaacatggaaaaggccccccccccaggggggccccccccggggaaaatttggggcggaaaaaaacaacaaatttttaaacccccgcttttggggggggggaaaattcccaagaacctttggtgttttttttaaaaaaaggggggggccccccccccccctccaaaatttttgtgtttgggggggttttcctcccccaaaaaaaaaaaaaaaaaagtggggcccccccccccaaaanaaacccccgcccccgggggtttnttcccccaaaaaaaaaaaaagaaga

SEQ ID NO: 40709 - DNA, 681 bp, Zea mays
  misc_feature: Ceres CLONE 1434247-F
  misc_feature: Encodes the peptide sequence at SEQ ID NO. 40710
  misc_feature (681)..(681): n is a, c, t, g, unknown, or other
aagctggagctccccgcggtggcggccgctctagaactagtggatcccccgggctgcaggaattcgcacgagaccattacctagaacatcctaatcgaaaacaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaagctgctgaggaaaagggatgttcctgatgacaactacaccaatgccttccttggctttgggccagagaacaccaactttgcagttgaattgacatacaactatggcgttgacaagtatgacattgggaacgggcttttgggcatttcgcaattgctaatgatgatgtgtacaagttagctgagaatatcaaatcccaggggtggtaagatcccccgcgaacctggtcctgtcaagggaggatcacctgttattgccttcccccaggatcctgatggcttcatgtttgagctaan

SEQ ID NO: 40710 - protein, 107 aa, Zea mays
  misc_feature: Ceres CLONE 1434247-F
  misc_feature: SWISSPROT Homolog: EC 4.4.1.5 Lactoylglutathione lyase
MATGSEASKAAEAVVDWHKHDSKRMLHAVYRVGDLDRTIKYYTECFGMKLLRKRDVPDDNYTNAFLGFGPENTNFAVELTYNYGVDKYDIGNGLLGISQLLMMMCTS

SEQ ID NO: 40711 - DNA, 692 bp, Zea mays
  misc_feature: Ceres CLONE 1434249-F
  misc_feature: Encodes the peptide sequence at SEQ ID NO. 40712
  misc_feature (329)..(329): n is a, c, t, g, unknown, or other
  misc_feature (394)..(394): n is a, c, t, g, unknown, or other
  misc_feature (411)..(411): n is a, c, t, g, unknown, or other
  misc_feature (421)..(421): n is a, c, t, g, unknown, or other
  misc_feature (469)..(469): n is a, c, t, g, unknown, or other
aaactggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctggncgtgccggccgcggtgtgggcgggcggcgccaacgcgcccatgtcagcggccgaccgtctccggncgggggcaccggacccngtcgtcctgnaggcgctgctccgcctgctggggtcccgcggcgtttcctcgagtccancgagtccacgcccaccaggggggggcggttatccgccctcacccgcgggggccaaccctgggggccggggcccgccttgggggcttcctaccccaaaaatgggttgaaaacccccaaaaaccctggtgggggggtggcccccctttaaaagacctgttttaaccccgggggcccaaacctttgccccccaaaccgggggtcccccctccccctttctgaagga

SEQ ID NO: 40712 - protein, 130 aa, Zea mays
  misc_feature: Ceres CLONE 1434249-F
  misc_feature (49)..(49): Xaa is any aa, unknown, or other
  misc_feature (71)..(71): Xaa is any aa, unknown, or other
  misc_feature (80)..(80): Xaa is any aa, unknown, or other
  misc_feature (96)..(96): Xaa is any aa, unknown, or other
MPPPSANGATAAAAAARDDMSPAEARLAMMELANMVSVPMALAAVIRLXVPAAVWAGGANAPMSAADRLRXGAPDPVVLXALLRLLGSRGVSSSPXSPRPPGGGGYPPSPAGANPGGRGPPWGLPTPKMG

SEQ ID NO: 40713 - DNA, 686 bp, Zea mays
  misc_feature: Ceres CLONE 1434255-F
  misc_feature: Pfam Name: SecA_SW Pfam Description: SecA Wing and Scaffold domain
ggatcccccgggctgcaggaattcgcacgagaccattacctagaacatcctaatcgaaaacaaagaaagggagatatacaaacactgtgaatctgctccggaaatattttggggattttctaatagctacctacttgaatgccgtgcaagagtcccgttatgacgatgcatatataggtggaattgaggtgaacgttcggagttttggacacagaaatcctctggaagagtacaagatcgatggctgccgcttcttcatctcaatgttgagcgccacacgacgtctcaccgtggaatcccttgtgcactactggtcgtcgcccatggagtccgaggagatcttcaacacagaggatcaatagcagaagacctgacgtggactggtgctgcaagttgtgggcaggttaattagcagagaggcacaggtataaacaggagccgcgcgcggcgtgtgttaaccctgtaaaatcacaagctgacatggccacggttgcgtcgatttcgcgctgtggctgtgcacctacatataaaactaagtacatctcaatgcacaagagggtagtaactggataggtgtggactgcaagacagtctgatccatcccacatcagcaatacggcgttgccgcaaaaaaaaaaaaaaaaaagcttatcgataccgtcgacctcgagggggggcccggtacc

SEQ ID NO: 40714 - DNA, 739 bp, Zea mays
  misc_feature: Ceres CLONE 1434257-F
  misc_feature: Pfam Name: Clat_adaptor_s Pfam Description: Clathrin adaptor complex small chain
  misc_feature (405)..(405): n is a, c, t, g, unknown, or other
  misc_feature (409)..(409): n is a, c, t, g, unknown, or other
  misc_feature (412)..(412): n is a, c, t, g, unknown, or other
  misc_feature (413)..(413): n is a, c, t, g, unknown, or other
  misc_feature (488)..(488): n is a, c, t, g, unknown, or other
  misc_feature (490)..(490): n is a, c, t, g, unknown, or other
  misc_feature (549)..(549): n is a, c, t, g, unknown, or other
  misc_feature (551)..(551): n is a, c, t, g, unknown, or other
  misc_feature (599)..(599): n is a, c, t, g, unknown, or other
  misc_feature (601)..(601): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (647)..(647): n is a, c, t, g, unknown, or other
  misc_feature (681)..(681): n is a, c, t, g, unknown, or other
  misc_feature (690)..(690): n is a, c, t, g, unknown, or other
  misc_feature (691)..(691): n is a, c, t, g, unknown, or other
  misc_feature (713)..(713): n is a, c, t, g, unknown, or other
  misc_feature (714)..(714): n is a, c, t, g, unknown, or other
cgcggtggcggccgctctagaactagtggatcccccgggctgcaggaattcgcacgagaccattacctagaacatcctaatcgaaaaactgccggctgtccggagtcccgaccaccgtcctcggctccccgccgtgaatccatcatcccgtaatggagacctgcccctcggtgaagaacatcctcttgctggactcggagggaaagcgcgtcgccgtaaagtacctacagcgatgactgggctactctatccgcgaagctggccttccagaagtcggtatttaccaaaacccataaagcgaatggcgggaacggaaagttgaaattggaaaggtttggagggtcaaatttgggggtatacaaagttcttcccagaaaccgggccttttttttggttcttgggggngtanaannaagagaggacgggcctcctcgatgggggggacctccgtgggggtggggccctcttcttaggggagggttagatcncncgctgagtacatctctgtgagacggattgtgtgacagtgaaggggcgggtgaggttggngnaagttgggtggtagggtgaagggcgagagcgaagtaggattgctatgngncatagggggtggcgnnntagtgtgggggaaaagcaaagggcatggntgtgtggagtgagtgggtgtgattatctttactnccgaccgtnnagagaaaggtagggagaggggnncagttgttcatatgtaacgagagag

SEQ ID NO: 40715 - DNA, 698 bp, Zea mays
  misc_feature: Ceres CLONE 1434264-F
  misc_feature: Encodes the peptide sequence at SEQ ID NO. 40716
  misc_feature (614)..(614): n is a, c, t, g, unknown, or other
tcgcgcgggctgcgggaattcgcacgagaccattacctagaactactaatcgaaaaaataaaaagtttgctagggactccagaagagagagagaggcgtccggagttcatcgccagagatgtctccgtccgccgacgcccccggcccggcctcctccgcctcggcgcccccgctcgcgcccctcatcgccgcgcagctcaactacctcctctcgcactccaagctgcccattagggtggtacagatctggtccggctgccgcaacggtcgccctgccgatcggttcaggctcgccatccccttctgcctcgactacgtccactgggatttcgtgtacaatgcgctgtctcccaaggtggcaccggacgtggtgttcggtccggaggatgagaggttccagccgctggtcgattacgctgctgctggaaatggcgataagagctgcttggcgcgttgggattgccgcgcccccgagggactccatgcgctcgtacaagagcttcgagaattgtacattgaataccaaaaaggagcgggttcaccatggtggatgaccccaagactagcgtttgaactaaagcacagttctctctagggagggggattggaggtcngccgtggtacccttctgcctgataggccagatggaggcccaagtttgctggtaccgccttcctgggagctctgacgtttgactg

SEQ ID NO: 40716 - protein, 158 aa, Zea mays
  misc_feature: Ceres CLONE 1434264-F
MSPSADAPGPASSASAPPLAPLIAAQLNYLLSHSKLPIRVVQIWSGCRNGRPADRFRLAIPFCLDYVHWDFVYNALSPKVAPDVVFGPEDERFQPLVDYAAAGNGDKSCLARWDCRAPEGLHALVQELRELYIEYQKGAGSPWWMTPRLAFELKHSSL

SEQ ID NO: 40717 - DNA, 813 bp, Zea mays
  misc_feature: Ceres CLONE 1434267-F
  misc_feature (36)..(36): n is a, c, t, g, unknown, or other
  misc_feature (37)..(37): n is a, c, t, g, unknown, or other
tgttccccctgtcctcccccttcccacggcttcccnncccccctttctcaaactggggctccccccggtggcggccgctctataacagtggatcccccgggctgcaggaattcgcacgagaccattacctagaacatcctaatcgaaaaatccatgcagtacagctccgtccccaatccaggccccgagctttattctttcttgctttgatatgttttcccggcccgagtcactatagtgtgcggcagcctttttcctcctcgctctccccccgatgagacctcacgggagcgaaatcctgcggcaaagcttcccggttcgtataaagggattctctatctaatcgactaacccgggtgaaaaaaaccccctccataccccgcgacagcatgagccacttcgccctccccagccgtgaatagcccccctcgccgtggccggctcccgccgccgccgatgcccaagacccctcttctatctaccccaagctcgcggcgccccccgggcgccccctccgctgccaccacgggcggactacgcccgggctgggaataagctcgacctcccttggggtgaaagcacatctgtttacgcgtggaggacaaagagacccccatgacacgatactatcatggcgggcaaaaagaagggggactccctccagcagggtgccgccggggtggggaaccccttgccacccaagagaactgtcctggtataaatagccccttagcgcccctcagtctcccggaattttctgattgccacgggtacccgggccgagaaggtggcccgttcttctcccaggcgggg

SEQ ID NO: 40718 - DNA, 709 bp, Zea mays
  misc_feature: Ceres CLONE 1434270-F
  misc_feature: Translation starting site: 352
  misc_feature (709)..(709): n is a, c, t, g, unknown, or other
agtggatcccccgggctgcaggaattcgcacgagaccattacctagaacatcctaatcgaaaacatttctgtgcgcatctggagctgttgttctaaacccccaaaccctccgtcctaacctctgcgccaccggcgtcaccaccgccggagccgcagccatgaacgccttcaggttcctcggggacatgacccacctcttctcggtcctcgtcctcctcctcaagatctacgccaccaagtcctgctcaggtaagccgtaccagcgatttcgaccgcccgttaggggggcttgccgcttacagatctgggcgccgccgcgcaggggtgtcgaggaagacgcaggagctgtacatgttggtgttcgtggcgaggtacctggacctcttcacggattatgtctcgctctacaactcggtgatgaaggtggtgttcatcaccagctcggcggccatcgtgtggtgcatgcgccgccacccgcaggtacgaagaacgtacgacaaggagcaggacaccttccgtcacacggtgctcgtcgccgccgcattcctgctcgcgctgatattccacgagcggttcaccttccgcgagatatgctgggcattttcaatctatttggaagcagtggctattctcccacaattagtgttgctccaaagaagcagaaatgtgggataacttactgggacaatatgtttttctgcctgggggn

SEQ ID NO: 40719 - DNA, 776 bp, Zea mays
  misc_feature: Ceres CLONE 1434271-F
  misc_feature: Encodes the peptide sequence at SEQ ID NO. 40720
  misc_feature (36)..(36): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
tattcccctttttctctaacggcttgttttccaatngngcnnnnnnnccaaactggagctccccgcggtggcggccgctctagaactagtggatcccccgggctgcaggaattcgcacgagaccattacctagaacatcctaatcgaaaaaactcgccgtctgccttctgcgcctccatttcggactctgtcccttgcaagttgggtctcacctccaaccatgggcaaagagaagtcccacatcaacattgtggttattgggcatgtccactctggcaagtctaccagcacaggacaccttatctacaagcttggaggcattgacaagcgtgtgatcgagaggtcccagaaggaggctgctgaaatgaacaagcggtccttcaagtacgcgtgggtgctccacaagctcaaggctgagcgtgagagaggtatcaccattgatatcgctctgtggaagtttcagaccaccaagtactactgcgcggtcattgatgcccctggacaccgtgacttcatcaagaacatgatcactggtacttcccacgctgactgggctgtccttatcattgactccaccactggtggttttgaggctggtatcttcaacgatggccagacccgtgaacatgctctccttgcggtcacccctggggtgaaacaaatgatttgctgctgccaccaaatggatggcaccccctcccaaaatactccaaggccacgtatacaaaaaaatttgttaaggaaagtcaccttcctcccctcatagatactcgggg

SEQ ID NO: 40720 - protein, 181 aa, Zea mays
  misc_feature: Ceres CLONE 1434271-F
  misc_feature (5)..(181): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVHSGKSTSTGHLIYKLGGIDKRVIERSQKEAAEMNKRSFKYAWVLHKLKAERERGITIDIALWKFQTTKYYCAVIDAPGHRDFIKNMITGTSHADWAVLIIDSTTGGFEAGIFNDGQTREHALLAVTPGVKQMICCCHQMDGTPSQNTPRPRIQKNLLRKVTFLPS

SEQ ID NO: 40721 - DNA, 802 bp, Zea mays
  misc_feature: Ceres CLONE 1434289-F
  misc_feature: Encodes the peptide sequence at SEQ ID NO. 40722
tggggggggcgccccgccaccaatgagtaggtgggtttggaggcccacctcgagaaagttgttatttatgggggggggggcggtttttatgtgtggatcccccggggggggggtgttcgcacgagaccattacctagaacatcctaatcgaaaagaaggatactgtttcataggcaggagccaggcaccggactttccaggaggataccacctcccgaagatggtgggacgaggacccgccaccggggcagccccgagaccccagctcgccgccgtccggcgcgggctgctcctcgcgtccggcctcgcggccgctgcctcctccctcccagtagccgagtcgtcctgccctccagacaactcactggtgagagagataggccgaaagcgacagcgcaactacgggagggaaggattctcgcatataactgtaacaggtgctcttgctccccggacgaggggggtggaaccctggctacgaagatctgggggccagggggaagggacccccatccacaggcattcttgtgagcaggcctttcattggcctcaaggggaagggcgtgttcccgctcgggtcggggtcgctgaagcacccaggagagcgcgggagaagttacctggcttgcggagagacacattttccgatcccggtaaatgatccacgataaggtcttggaattcgtgatgacgactaagagtgggcgaagttcttggggatcagaggccccgcccactcgggccagagaaatcttacatcacgagagaatggggagtaatgccttcaagacaggcttgggag

SEQ ID NO: 40722 - protein, 146 aa, Zea mays
  misc_feature: Ceres CLONE 1434289-F
MVGRGPATGAAPRPQLAAVRRGLLLASGLAAAASSLPVAESSCPPDNSLVREIGRKRQRNYGREGFSHITVTGALAPRTRGVEPWLRRSGGQGEGTPIHRHSCEQAFHWPQGEGRVPARVGVAEAPRRAREKLPGLRRDTFSDPGK

SEQ ID NO: 40723 - DNA, 723 bp, Zea mays
  misc_feature: Ceres CLONE 1434293-F
  misc_feature: Translation starting site: 167
  misc_feature (397)..(397): n is a, c, t, g, unknown, or other
  misc_feature (416)..(416): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
aagctggagctccccgcggtggcggccgctctagaactagtggatcccccgggctgcaggaattcgcacgagaccattacctagaacatcctaatcgaaaaacccatattattgataccaactagcaacatacatagtgaagtacactagcaacatcttagcaccaatggcagccaagatttttgccatccttgccctccttgctctttcagcaagcgttgctaccgcgactattattccacaatgctcacaacaatacctctctccggtgacagccgcgagatttgaatacccaactatacaatcctacaggctacaagaggccatcgcagcaagcatcttacggtcgttagcattgaccgtccaaacaccatatgccctatttgcacaccatccntaatgaatctatatctccnaaagatcgcagcacaacaactacaacaacagttgctttccacaatcaatcaagtagttgcagcgaacctttgctgcttaccttcagcaacaacatttcttccattcaatccactaactggggggaaccttgtttgctacttgcgggcccaaaagctactacatttcaaccatttgttagggaccttgggtgcttttttatgggaaaagagttgtttcctttccccaaaaatgtggggaaaaattggttttttttgaaaaaaaaaaaaaattgtgccattttcccccggtggtgggggagaaaannng

SEQ ID NO: 40724 - DNA, 688 bp, Zea mays
  misc_feature: Ceres CLONE 1434306-F
  misc_feature: Encodes the peptide sequence at SEQ ID NO. 40725
  misc_feature (335)..(335): n is a, c, t, g, unknown, or other
  misc_feature (421)..(421): n is a, c, t, g, unknown, or other
  misc_feature (422)..(422): n is a, c, t, g, unknown, or other
  misc_feature (431)..(431): n is a, c, t, g, unknown, or other
  misc_feature (452)..(452): n is a, c, t, g, unknown, or other
gggctgcaggaattcgcacgagaccattacctagaacatcctaatcgaaaaaagaaggatccccaccccgaccgacctaccctaatcggcgatggcgacggtggcgatggacatctcgaagcccactccagtggcgtccgacgacgaggccgcggcggcggccaaggggaggagcggcggagggggcgaggggctgcggcagtactacctgcagcacatccacgacctgcagctccagatccggcagaagacccacaacctcaaccgtctcgaggcccagcgcaatgacctcaactcccgagttagaatgctcagggaagagttgcagttgcttncagagcctggctcatatgttggtgaggtggtgaaggtcatggggaaaatcaaggttctgggtgaggtacaccccgagggcaatatnngtgtgatantagatagagcattgatatcancaagatcacccctttcacaagagtcgctcttcgaaatgatagctatatgctccatcggatccctaaaaggcaaggtgatcccttgggccaacctcctgaaagttgaaaagggtcccgggtcccccttatgaattggttggggcgcttgacccccaattaaaaaagttcaaaggggctttgggcttctcctccaaccccggaaatttttggagcccttggaattccccaccaagggt

SEQ ID NO: 40725 - protein, 163 aa, Zea mays
  misc_feature: Ceres CLONE 1434306-F
  misc_feature (82)..(82): Xaa is any aa, unknown, or other
  misc_feature (110)..(110): Xaa is any aa, unknown, or other
  misc_feature (111)..(111): Xaa is any aa, unknown, or other
  misc_feature (114)..(114): Xaa is any aa, unknown, or other
  misc_feature (121)..(121): Xaa is any aa, unknown, or other
MATVAMDISKPTPVASDDEAAAAAKGRSGGGGEGLRQYYLQHIHDLQLQIRQKTHNLNRLEAQRNDLNSRVRMLREELQLLXEPGSYVGEVVKVMGKIKVLGEVHPEGNXXVIXDRALISXRSPLSQESLFEMIAICSIGSLKGKVIPWANLLKVEKGPGSPL

SEQ ID NO: 40726 - DNA, 680 bp, Zea mays
  misc_feature: Ceres CLONE 1434307-F
  misc_feature: Encodes the peptide sequence at SEQ ID NO. 40727
  misc_feature (368)..(368): n is a, c, t, g, unknown, or other
  misc_feature (462)..(462): n is a, c, t, g, unknown, or other
agagctggagctccccgcggtggcggccgctctagaactagtggatcccccgggctgcaggaattcgcacgagaccattacctagaacatcctaatcgaaaaaattgaaaacagggccttggtcgagttaaaaaaaacgcgagtgaaacacactgacaccgcaaacacgccaaccggcctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccnagacgctgacgggggagcttccagctccgacgccaaggagaacgccgatccccaccccgagccacaggttgaggtggagatagagtacgtgccngaagaaggccgagcttgacgaccctctcctggatgatttcaaggccatcttcgagaagttcaccttcagggaccctgctgcaacggccggggaggatgataataaaaaaccagggtgccccctgatgccacaaaaaaggggtccctgggtgatgttgaccaccacccaaaatgattgagccggaggcaaaccaaaaaaaagggacggagggcctttta

SEQ ID NO: 40727 - protein, 87 aa, Zea mays
  misc_feature: Ceres CLONE 1434307-F
  misc_feature (51)..(51): Xaa is any aa, unknown, or other
MAAAAEVDPSPNPPPTTASGLSKTKTREADRRRRRRSKAKKNKSVTEADAXDADGGASSSDAKENADPHPEPQVEVEIEYVPEEGRA

SEQ ID NO: 40728 - DNA, 792 bp, Zea mays
  misc_feature: Ceres CLONE 1434311-F
  misc_feature: Encodes the peptide sequence at SEQ ID NO. 40729
  misc_feature (22)..(22): n is a, c, t, g, unknown, or other
atgggcacaagatagtggtgtntttgtgttttgattatgtgactcgtgttctcataagcacacgcggtggcggccgctctaaactagtggatcccccgggctgcaggaattcgcacgagaccattacctagaacatcctaatcgaaaaatcaaggttcactccctccgccatcactggaagatgggaccgcagaaggtcgagacgatgcggcggccgaggcccgagagaggagaacggcggatcgacgccgccattgaccacctcgcccagtacggcttcgcaaagccccaaatccgcaaggtcatcaacgacctccttcagctgtacgggagagatggatgggtgttcctggaggagggatcatacagtatcgtgcttaaagtcctggaagaacaggcgcagcaggatcagacacaagaagcagctgctgcagaagaggcattaccacaaaacggtatggaagtctcacgagtgaatggtgaggcaccgaatgaacctccgtcaacccttggaactgcaagcttctcccagcagttccacctttacttgcagtgcccacaacctcgagtaccttcgatgacgaacgtacatccgtggccagtaggaacaattattcatcagcagtcctccagcgtttgaggaggcaccgctgtccgtgcgcctagcaacttgctcgataggcatctgtggttcgggtgaactaattacgttggggcgccaaactgatatcttctgtgttggtgagatgtgttatattggacacttccacttcgtgggttggatggcgactg

SEQ ID NO: 40729 - protein, 152 aa, Zea mays
  misc_feature: Ceres CLONE 1434311-F
MGPQKVETMRRPRPERGERRIDAAIDHLAQYGFAKPQIRKVINDLLQLYGRDGWVFLEEGSYSIVLKVLEEQAQQDQTQEAAAAEEALPQNGMEVSRVNGEAPNEPPSTLGTASFSQQFHLYLQCPQPRVPSMTNVHPWPVGTIIHQQSSSV

SEQ ID NO: 40730 - DNA, 692 bp, Zea mays
  misc_feature: Ceres CLONE 1434313-F
  misc_feature: Encodes the peptide sequence at SEQ ID NO. 40731
tctgaactagtggatcccccgggctgcaggaattcgcacgagaccattacctagaacatcctaatcgaaaaatacattgaccctcgtcatctacaccctctctctctcccaaatcctctcactgcgaatctgcgatggccgttgcgcagcgtctcaccgtgctggagctccaccattgctgctgcccaacacctcgtgatacgtcgcgcctagacttgagctcgctgcgcgctgggagccccgccgagttcgctgttgagcaccgccgcggaagactcttcctgccgtgcgtcgtcgcaagactgcgatccatttccgagcttcgaggaatcgacagtcaagcttcggcgaccaagaggtcgaactcttcgagttctacaaggctgaagaccatgagcatctgtttggtgaaggttgtccacattgcaaccactgctcaggagaagacgaagtcgtggaaggagacttccaggagttccaagactacgacgagttttaggtatgggttggcggcaacccccagtcagctgcctgtgaaggccttatctttactgcgtttcgctagcactttgatttaactgttaagttgatgcctatgtggatgtctatgactctgtgatgtaataagttaatactcttttatgttattattcgagcactgtgcgatgaaaaaaaaaaaaaaaaacttatcc

SEQ ID NO: 40731 - protein, 147 aa, Zea mays
  misc_feature: Ceres CLONE 1434313-F
MAVAQRLTVLELHHCCCPTPRDTSRLDLSSLRAGSPAEFAVEHRRGRLFLPCVVARLRSISELRGIDSQASATKRSNSSSSTRLKTMSICLVKVVHIATTAQEKTKSWKETSRSSKTTTSFRYGLAATPSQLPVKALSLLRFASTLI

SEQ ID NO: 40732 - DNA, 543 bp, Zea mays
  misc_feature: Ceres CLONE 1434321-F
  misc_feature (271)..(271): n is a, c, t, g, unknown, or other
  misc_feature (273)..(273): n is a, c, t, g, unknown, or other
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatgggcggcccaagatattttcccatccttatgcttcctttgctcttttctgcatgttgtgctaacgcgaccattttttcttcatactcacaaggttcccananaaaaggtggcctttttcccccaactttcaataaaggaccgtttcaaatgggaaaacccgcccttaaccctcagggtccccaaaagaattcaaaaagaaatttctttttaccccccggttttttaaaaacccccccccttttttggggcccttttggaaaaaaaaaagggggaaaaaagggggaaaactttggtcaagaggaaaaaccaaaaaattttggaaaaaatttttccccccttttttaaaaaaaaaaatttttttcttctccccc

SEQ ID NO: 40733 - DNA, 556 bp, Zea mays
  misc_feature: Ceres CLONE 1434335-F
  misc_feature (394)..(394): n is a, c, t, g, unknown, or other
  misc_feature (521)..(521): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
tcccccgggctgcaggaattcgcacgagaccattacctagaacatcctaatcgaaaaccgaaatttgggtgaacccgaacgcgcagtcctagttcaagctgaaaggagaacataaaagaggagaggctagggttttggcgtccgagaccaaaccaagctctctccggcgacggtgagggctcgatatcggagtccagtaggcggctcctgctgcttcggcggtccctaatccctctctcggcagtgtacagatggcgtccggcggtccggcgctcgagccgctcgtcgaacagggtcaatctccggtcattcaccaaaagatgggcccccaaatctcggggggacccccccggggggaattttttttaggggcccccccccccaattttttccncccaaaaaacccccccggggggggggggtttttttttaagagaggggggaccaaaattttgttggtggttttttttggggggggaaaaaaaattttgggggggggggtgaaaaaaacccccccccantattggtttnnnnnnggggcgcccccccccccccc

SEQ ID NO: 40734 - DNA, 577 bp, Zea mays
  misc_feature: Ceres CLONE 1434336-F
  misc_feature: Encodes the peptide sequence at SEQ ID NO. 40735
  misc_feature (302)..(302): n is a, c, t, g, unknown, or other
  misc_feature (409)..(409): n is a, c, t, g, unknown, or other
aaagctggagctccaccgcggtggcggccgctctagaactagtggatcccccgggctgcaggaattcgcacgagaccattacctagaacatcctaatcgaaaaaccaccaaaccaatcgctggatttgtccagagtatttccggtttcaccgccctagatctgacccgagacgccgcgtcttcgctgagatggcgattactgtgaggcggtcgacgatggtgcgcccggcgcgggagacgccgcggcagcggctgtggaactccaacctcgacctcgtggtgccgcgcttccacacgcccangtgtctactttctacggccgcgacgggccccgtgccggaatgccgaaggggttttttcacacggaaaaaggaaattccgggccccccccctcttaaaaaaaaaaacnccttcgcttttttcaaaaagggggcccccccccccgaaaaaaaaaaggggggaaaaacacccccggggggggggggggtttttttttaggggccccccccccccctccctcttttaaaaaaaaaaagagattccccccccccccacgaggagaaaaaacccccccccc

SEQ ID NO: 40735 - protein, 102 aa, Zea mays
  misc_feature: Ceres CLONE 1434336-F
  misc_feature: SWISSPROT Homolog: EC 2.3.1.144 Anthranilate N-benzoyltransferase
  misc_feature (38)..(38): Xaa is any aa, unknown, or other
  misc_feature (74)..(74): Xaa is any aa, unknown, or other
MAITVRRSTMVRPARETPRQRLWNSNLDLVVPRFHTPXCLLSTAATGPVPECRRGFFTRKKEIPGPPPLKKKNXFAFFKKGAPPPEKKKGGKTPPGGGGVFF

SEQ ID NO: 40736 - DNA, 638 bp, Zea mays
  misc_feature: Ceres CLONE 1434345-F
  misc_feature: Encodes the peptide sequence at SEQ ID NO. 40737
  misc_feature (546)..(546): n is a, c, t, g, unknown, or other
  misc_feature (552)..(552): n is a, c, t, g, unknown, or other
  misc_feature (574)..(574): n is a, c, t, g, unknown, or other
  misc_feature (588)..(588): n is a, c, t, g, unknown, or other
  misc_feature (589)..(589): n is a, c, t, g, unknown, or other
  misc_feature (602)..(602): n is a, c, t, g, unknown, or other
  misc_feature (611)..(611): n is a, c, t, g, unknown, or other
gctctagaactagtggatcccccgggctgcaggaattcgcacgagaccattacctagaacatcctaatcgaaaagcttcatctcctcctttcctccccaaaagacacaagagggggaagagagagagaggagaggcagagagaagagggggaggcagtccagtgtccacgcaggtacgctccacagaagagagatggcgatgcggatggcggcggcggcagtggcgctggtggcggtgatgggcgtgctggcgccccgagcggcggcgcagacgccgaactgcgcggagaagctgatcccgtgctcgccgtacatgaacacgacggggacgccgccggatacctgctgcggcccgctcaaggacgccgtccagaacgacctcaagtgcctctgcgacttctacgccttggccggaatcttttaagggcttttaaaataagcccttaaaaaaggggccttgcggccttttcccaaaagggggtgtgggggggcgtataaaaaaaaaaaaaaaacccccccccccatccgggaaagcgcccccgcgcnccggcncttcctccttctctccctccancccccccccccccnncacccttttgggnggtgccccnccccccccccccccctcccccccgccc

SEQ ID NO: 40737 - protein, 76 aa, Zea mays
  misc_feature: Ceres CLONE 1434345-F
MAMRMAAAAVALVAVMGVLAPRAAAQTPNCAEKLIPCSPYMNTTGTPPDTCCGPLKDAVQNDLKCLCDFYALAGIF

SEQ ID NO: 40738 - DNA, 659 bp, Zea mays
  misc_feature: Ceres CLONE 1434351-F
gctggaattcgcacgagaccattacctagaacatcctaatcgaaaaaagacaggaatccataggactctgttactcttcactaatatgaactcgataactcaagatcaaggaacccgattagagggttctacagatgctttcctcgatcgttgcacttcttgtctgagttgcagcctcctgttactgatcatactacgcctcaatcaccctgagcctggggagacgactccccctcctcagagtactccgtcaacaataccactctccgagcagaagatctctggatggtagagaatccttcctccagacactctctcgcaatcctacacgatgccggtccatgcatttaccagctccatatagatgcacattcccatctctaacgctcttattgaggaacgatgcatatattttaagtttttcgatagatctacggtatggagaatgtgatccacaccctacacgtacggtcaacagtgaagcacttgacattcaaaaactcgctgataaactcaacatccgaccagagcactgtgttctagggttatcaatcgggcgatcactcagtattacggatgcctcaaaaatcgtcctccacctattagaatggaaccatccttagcgcttgccaatttgacagctactagtttggaccaag

SEQ ID NO: 40739 - DNA, 612 bp, Zea mays
  misc_feature: Ceres CLONE 1434357-F
  misc_feature: Encodes the peptide sequence at SEQ ID NO. 40740
  misc_feature (159)..(159): n is a, c, t, g, unknown, or other
  misc_feature (164)..(164): n is a, c, t, g, unknown, or other
  misc_feature (165)..(165): n is a, c, t, g, unknown, or other
  misc_feature (346)..(346): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccnggccnnggcggcaccgcgctcgcaggggctagccaacgagacggcagcaatggcggaccgtgaccgcagcggcatctacggcggcgcccacgccacctacgggcagcagcagcagcagggaggaggcggccgcccgatgggtgagcaggtgaagggcatgctccacgacaaggggccgacggcgtcncaggcgctgacgggtggcgacgctgttcccgctgggcgggcctgctgctggggctgtccggggctggccccttacggctctccggggggggcttggccctgggccacccccgggggtcccggaactttaaaccccctggcggggcccccccccgcgctgtttaatggggaaaggccgtccaggggggttccccccacttccggggccccctgggggggcccggggggccctttccccccctcaaacggggcccccccccaaaaaag

SEQ ID NO: 40740 - protein, 134 aa, Zea mays
  misc_feature: Ceres CLONE 1434357-F
MADRDRSGIYGGAHATYGQQQQQGGGGRPMGEQVKGMLHDKGPTASQALTGGDAVPAGRACCWGCPGLAPYGSPGGAWPWATPGGPGTLNPLAGPPPALFNGERPSRGVPPTSGAPWGGPGGPFPPSNGAPPQK

SEQ ID NO: 40741 - DNA, 665 bp, Zea mays
  misc_feature: Ceres CLONE 1434367-F
  misc_feature: Encodes the peptide sequence at SEQ ID NO. 40742
  misc_feature (437)..(437): n is a, c, t, g, unknown, or other
agctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcangagctgtacgtgtacgagatcaacgagcgggaccgcgagagccccgcgtacctgcgcctcagcgcaagcaaaaacgagaacgcgctgggcgatcttgccccctccacaacaagtgtacaacggcagcctggacaagcgctgggcgtcaccgcgggcatctggtggttatccaaaagttcccgaaccgaaaggggaacgctacaagccatttaaaggttcactttaaaa

SEQ ID NO: 40742 - protein, 137 aa, Zea mays
  misc_feature: Ceres CLONE 1434367-F
  misc_feature: SWISSPROT Homolog: EC 5.3.99.6 Allene-oxide cyclase
  misc_feature (67)..(67): Xaa is any aa, unknown, or other
MAAALRCPASVRVSGPAAAGLAKVRQASRVVAVSGARQSRSGGVAVRASLFSPKPAAAKDARPTKVXELYVYEINERDRESPAYLRLSASKNENALGDLAPSTTSVQRQPGQALGVTAGIWWLSKSSRTERGTLQAI

SEQ ID NO: 40743 - DNA, 725 bp, Zea mays
  misc_feature: Ceres CLONE 1434381-F
  misc_feature: Encodes the peptide sequence at SEQ ID NO. 40744
aagctggagctccccgcggtggcggccgctctagaactagtggatcccccgggctgcaggaattcgcacgagaccattacctagaacatcctaatcgaaaaaatctgacaagtgggccacaatgattgtatcaacatagcctcccaacgatttgcttcgtccgacgtccactacctttaccgccgcggcgccgccccagaatttcccccttcttcgttcgcggaaacgagagcgcccgaaggaatagcgaggtcggaggcgccgttcgattccagaagtttccatcgccgcgccgtgacgatcttgtgtagcctgcgcattggtctgctcgtcggacgtcggcgtcggtcgagtcgtggggtgcgcggtcgtgcgagatcgaggcggggagctcgcgaatcggaggccgcggggcgcaatgccgcgtctgtagggatggcggaggcggcgccatggcgaggggcgtagcgcgggcggtgtctttcgggcgccgtgccacaacggggtggtgctcctaccggcgcgtcaccgtggccgtctgcatcggcaaccttgtcgccgtgctgctcgtgctccgctccctcaccgcccccgcttccttcgcacccaccgctcccaaccgcggggaagtggtgcagtacacggaggagcagattaggtgggtggaggagtcgatcctgattcgccgcgaggctgagcccgtctagctcgttctggcggtaaaa

SEQ ID NO: 40744 - protein, 84 aa, Zea mays
  misc_feature: Ceres CLONE 1434381-F
MARGVARAVSFGRRATTGWCSYRRVTVAVCIGNLVAVLLVLRSLTAPASFAPTAPNRGEVVQYTEEQIRWVEESILIRREAEPV

SEQ ID NO: 40745 - DNA, 716 bp, Zea mays
  misc_feature: Ceres CLONE 1434382-F
  misc_feature: Encodes the peptide sequence at SEQ ID NO. 40746
aagctggagctccccgcggtggcggccgctctagtactagtggatcccccgggctgcaggaattcccacaaaaccattacctaaaacatcctaatcgaaaaatcccgccgcgagtttccaaaaccccaaccaatcgcgcctcagatcacgcgagggcgtgagggggaattcgctctcggatcctccgctcagccgtcgatcgatcgtccgggccgggggctctccggcggcaccggggccatggaggaggacccgctcatccctctggtgcacgtctggaacaacgccgccttcgaccatgcctccgcctccgcctccgcgtggcacgcccattcccctgcgcccgctagcgcccgcgagggggacaaggagaaccaccgccccgagcccgacgttgatgcggaggtcgacgacgttcaggccgagagttaccacatcgaggcggagatcctgcgcctgtcttcccgcctccaccacctccgcgcgctcaaggtacggagccgcccaagcgtggacaggacgcgcggacacaaatgggggggctcaatctagggcaacctcgacgtcgcccgctgcccgtcaactccgaccccgctcaccgactatgaccagccctagcggcgacccagggctttgaacaaagcctatacagagggggcccctggccggaggccccaaggggggggaactcccaggccttccggggcccctttaga

SEQ ID NO: 40746 - protein, 103 aa, Zea mays
  misc_feature: Ceres CLONE 1434382-F
MEEDPLIPLVHVWNNAAFDHASASASAWHAHSPAPASAREGDKENHRPEPDVDAEVDDVQAESYHIEAEILRLSSRLHHLRALKVRSRPSVDRTRGHKWGGSI

SEQ ID NO: 40747 - DNA, 708 bp, Zea mays
  misc_feature: Ceres CLONE 1434383-F
  misc_feature: SWISSPROT Homolog: EC 2.7.10.2 Non-specific protein-tyrosine kinase
agctggagctccccgcggtggcggccgctctagaactagtggatcccccgggctgcaggaattcgcacgagaccattacctagaacatcctaatcgaaaaatcagacagagagattcccgatcgccaccgccgactggactcccctcaaagggggccacagcacagcgagcatggtgagaccggcatcaacgtgggcctggcagcagcttgaaggacccggcgacgctgctgcggcgggtgcggacccgggcgcccttgtcgacgcaggtggtggggttcctgactctgctcgtctctggggccgtgctgctgctgctgacgggggtgacgctgacggacgccgtgatggcattcttcttcctgggccccatcgcgctgcatcccttccccatctgggtgcccgaccccgtctggatttccgacatcgtggcaggagctgtctaaaattgggccttccactttctacaactagctttgtgttgctgcatatgaccctcctgtgttgctcactgacgctcgtttgcccaccgggtgcactgggagaacatgaccctcattatgttcgacactttcattgttcctgccctgtacgttgcaattcaatacctgctctcactctatgaggatgccacgactagtgcgtttgttctcgactcccgtgatgcatgtactccactgccgtccttgatgcagctattatcttcctc

SEQ ID NO: 40748 - DNA, 878 bp, Zea mays
  misc_feature: Ceres CLONE 1434386-R
  misc_feature (776)..(776): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (836)..(836): n is a, c, t, g, unknown, or other
  misc_feature (837)..(837): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (848)..(848): n is a, c, t, g, unknown, or other
  misc_feature (850)..(850): n is a, c, t, g, unknown, or other
  misc_feature (855)..(855): n is a, c, t, g, unknown, or other
  misc_feature (857)..(857): n is a, c, t, g, unknown, or other
  misc_feature (869)..(869): n is a, c, t, g, unknown, or other
ccgattgggtaccgggccccccctcgaggtcgacggtatcgataagcttttttttttttttttttaaaggaaacttgttttattgtaaaaaacgactcaccccccatggcttgccacctcatatttcgatacaacacaaatttttctatctaaaaggcacccccaacaaagggttgctgtaaaaacatggggggaacccccatggccattgggttaaacataaatggaaactgctgttgcaccataatctgcaaaacggcgtcccagtgacattggggcatcatcatttgcaacatcatgctcggcaaaaccattggggacatcatgctcggcatcatcaagggggacatcatgttaggcgtcatcatctggggcatcatcactggcatcgtctaaagcggaaaggccaacatttgctgcagcatcggggacggacaccccatcaagctggcaagcccctgttgcatcatgcagaactgcatgcatgggttcatggtccccaatggcatgactgggggcaagtcccctgaaatatgggccccactagtggcccttgcccaaagagctaggaaagcgaacaatgcaagcttcttggctgccatggcgggggtgcccttgcttcctaaagtatagaatagtaaatatgtgcaactgaggccgatttttcaattaggatgttctaggaaagggcctcgtgcgaattcctgcaccccgggggatccctaatttctagagcggccgccaccgcggtggacctccgctttgtcctaaaaaangggggggattataaaaaannnnnnnnnnnnnnnnnnnnnnnnnnnnnnnnngnnnngggnngnnnnnggggngnggggntngggggggggggnggggggggg

SEQ ID NO: 40749 - DNA, 708 bp, Zea mays
  misc_feature: Ceres CLONE 1434387-F
  misc_feature (708)..(708): n is a, c, t, g, unknown, or other
aaactggagctccccgcggtggcggccgctctatactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcgcagactcgtcgtcggatccaaaagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactacgcaatccagctttctccttataaagaaatcaatggataaatttaaaaaaagcagagcatctaaccaataagaaaaactgatgtcacgaacttgacagttgacttttcgcgcaaacaaacaaacaaacactacgtactgtgctctgcttatggatacatacatgcatactagtagctcatatatgcgtacaagtgcgccccgcaggcccaccttcgtgggcatctggaagaagcgtgcggtggagcagtactcgcccatcccgtacgtggcgacgctgctgaactgcatgatgtgggtgctgtacgggctgctcn

SEQ ID NO: 40750 - DNA, 723 bp, Zea mays
  misc_feature: Ceres CLONE 1434390-F
  misc_feature: Translation starting site: 166
aagctggagctcaccgcggtggcggccgctctagatctagtggatcccccgggctgcaggaattcgcacgagaccattacctagaacatcctaatcgaaaaagctggagggcaccaagctaacatttagttgcaaaggagcgctaggaagaagaatcaacgagccatggcctccggtggcccgaaacccaaactggcctacatcatcttgtacgtgagggacgtggagaaggctgcctccttctacgacgccgccttcagctatgccgtcggccgcctcgaccagttcagcaaataaaacgcgcgcgcgtgcgcctgtgctgcctgatccggatgcgcgcctaattaatctgccgcatatgctgcgcctttgtgggttatagtttgccggcggacggagctggacagagctgcgactaccatcacgattcacgccgctgctcctacgtgagacggacaagctgtcggaggcggtgcatctgccggactcgtcggccctcggacggggctccgagtatgtctgcttcgactacgagaaccgtgtactcgcagtacaagctcctcacgcacaaccgagcggtggccgtgagcacgccggacgacaatccctgcggccagaagtccggcttcgtgcaccacatgcacggaaacatcatgcgcatcgagagctacgtgcgagagtagtcgcattcggctgcatcaccatcaatcgatcgatcacctt

SEQ ID NO: 40751 - DNA, 766 bp, Zea mays
  misc_feature: Ceres CLONE 1434392-F
  misc_feature: Encodes the peptide sequence at SEQ ID NO. 40752
  misc_feature (17)..(17): n is a, c, t, g, unknown, or other
  misc_feature (31)..(31): n is a, c, t, g, unknown, or other
  misc_feature (43)..(43): n is a, c, t, g, unknown, or other
gcccccccccccccccncccccatcttggangttacccccccncctaaactaggactccccgcggtggcggccgctctagactagtggatcccccgggctgcaggaattcgcacgagaccatacctaaaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcaccagaaaaagaagctcaagaggggcggcggcggcgggaggcgctcgttcgcggcggaggacgatgaggacttcgaggccgactttgaggtcttcgaggccgactccagtgattcagatttggagctcagggaggggactgacgacgacctcgtcgagatcaagcccttcactgccaagaggactttctccagcgatggcttaagcaccatgactagtgctgtaccaaggtccgccaagaggaagagaaagaatctatacaggggtatccgcccagcggccttggggcaagtggggctgctggagatcagagatcctcagaaaggctggttcgggttttggcttgggtacttttcaatagtcccggaggatgctgcacgaaaccttataatgcccaaagccgccccaagaaatccgtgcgcaagaaaggcccaaggtttaacttttccctgg

SEQ ID NO: 40752 - protein, 175 aa, Zea mays
  misc_feature: Ceres CLONE 1434392-F
MCGGAILANLREPAPRRLTERDIWHQKKKLKRGGGGGRRSFAAEDDEDFEADFEVFEADSSDSDLELREGTDDDLVEIKPFTAKRTFSSDGLSTMTSAVPRSAKRKRKNLYRGIRPAALGQVGLLEIRDPQKGWFGFWLGYFSIVPEDAARNLIMPKAAPRNPCARKAQGLTFPW

SEQ ID NO: 40753 - DNA, 826 bp, Zea mays
  misc_feature: Ceres CLONE 1434393-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (39)..(39): n is a, c, t, g, unknown, or other
  misc_feature (41)..(41): n is a, c, t, g, unknown, or other
  misc_feature (44)..(44): n is a, c, t, g, unknown, or other
nnnnnnnttttnnnnnnnnntttgtgcnacccccgcctncnccnccaagctggagctccccgcggtggcggccgctctattacagtggatcccccgggctgcaggaattcgcacgagaccattacctagaacatcctaatcgaaaaacgaactctttctgagtcttgaccgttggaaccgttcctctcgcgcctgcgacacactccggcttgcctgggaggagccagcgctcgcccgcgcggtcctttatattatagcagggggaatgagcgtccgctccccgagccacaacctcctcgtcccctcgagaactgtaccagcacgcgccgactttgattgcacctggtctgagggcagagaacaacagagggggaaagggggaaataaaacgctggttggtgcctttgtgcttcagcgggatgcgcggagggtgggcaggacggatgagaaaaggagtcatcactccccccgcctactggctttaatcgccggctagcaccccggggctcctcggccagcccgcattccaatgacgaggaataaggaagaatgaggtgcccacgtggcaaccaaaagggctgccgggggccgcccgctcggcggcattcacccttcccaaccgaaggtagaatgcctcccgcatcttgggaaaagatctaagggccttgtcccgggacaaaactggagtgccccgggacccgcgtggaccccccccctccttgtgaaaattgggccaggccccccgacagacgccctccctcccacgcctgagaggggcaaaacggtccataccctcgccggtgaatctggaatcctcctccgcccc

SEQ ID NO: 40754 - DNA, 877 bp, Zea mays
  misc_feature: Ceres CLONE 1434394-F
gggggagggagggggggggagggggtggggggcgttttcctccaaaaactggggctcaccgcggtggcggccgctctaaattagtggatcccccgggctgcaggaattcgcacgagaccattacctagaacatcctaatcgaaaaatgtccagtatatccgacgcggagtcgcagtcgcaggcacacactgaattctctttacctagctaagagagggtagccacaccaagacaggatgcagacggcgagggtgaaggcgaacgacatgatgagctcggcgaacgagagggtgaacgaggggacagcacagatgccagggcaagaggggcggaggcgacggcggccactctcggcgagaaggagatgggccgaggaggccgccctgccccgggaaggacctgggccaacgccgaacaagcgggcgggggaggggccgaccacccgaggcggacgcccgcctcttggccacctactggccttcgcggtgccccctcctcgggtcctggacggccaaccacgggcggcttggaggggggggggccaacccacagtgaaccccgggccgcggcgggaaaaaagaaacgcgtcgcgcggggggacaaggggcattggggggacaaactaccgcccggatagactgtgggggtccgcggcccgtgggagcggcggtcgggcggttctatttcgcgggtggcccccgccgaagaaaaaaaacgaactccgggggcggccccccgccttaattttctctcggaacccgagcgcgcgtgacgcttgtaaatagggggggcaggcggagggcgccgcgctggggggcgggcgcgccaatatatcctccggggcaggtagacgctgcccggtcgggggggcgggggg

SEQ ID NO: 40755 - DNA, 681 bp, Zea mays
  misc_feature: Ceres CLONE 1434398-F
  misc_feature: Encodes the peptide sequence at SEQ ID NO. 40756
  misc_feature (627)..(627): n is a, c, t, g, unknown, or other
  misc_feature (681)..(681): n is a, c, t, g, unknown, or other
aagctggagctccccgcggtggcggccgctctataactagtggatcccccgggctgcaggaattcgcacgagaccattacctagaacatcctaatcgaaaaattccattccgcacaaggctaggcacaagcgaaccaaacccatggcgtccgacggcagcggcgtggtgacggtgtacggcaactacggcccggagctgctggagccgtccaagcagcccaagtcggcgactttctccatcagggtggggctggcgcaaatgctccggggcggggtcatcatggacttggtgacccccgaacaggcgcgcctcgcggagaaggccggcgcgtgccccgtgatggcgctggagcgggtccccgccgacatccgcgcgcagggcggcctggcgcgcatgtccgacccgagcctcatccgcgacatcaagcgcgccgtcaccatcccggtcatggccaatgcccgcatcgggcacttcttgaaggcccagatcctggaggccgtgggcgtcgactacgtggacgacagcaaggtgctgacccccgccgactacgcgcaccacatcaacaagcacaacttccgcgtccccttcgactgcggctgccgcgacctcggccaggcgctccacanggtgcgcgagggcgccgccatgatccgcaccaagggggaggccggcacgggcan

SEQ ID NO: 40756 - protein, 179 aa, Zea mays
  misc_feature: Ceres CLONE 1434398-F
  misc_feature (29)..(179): Pfam Name: SOR_SNZ Pfam Description: SOR/SNZ family
  misc_feature (162)..(162): Xaa is any aa, unknown, or other
MASDGSGVVTVYGNYGPELLEPSKQPKSATFSIRVGLAQMLRGGVIMDLVTPEQARLAEKAGACPVMALERVPADIRAQGGLARMSDPSLIRDIKRAVTIPVMANARIGHFLKAQILEAVGVDYVDDSKVLTPADYAHHINKHNFRVPFDCGCRDLGQALHXVREGAAMIRTKGEAGTG

SEQ ID NO: 40757 - DNA, 672 bp, Zea mays
  misc_feature: Ceres CLONE 1434399-F
aaagctggagctccccgcggtggcggccgctctataactagtggatcccccgggctgcaggatttcgcacgagaccattacctagaacatcctaatcgaaaaagatggctgatagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagaggcccagctccaagcctccagccatcggcgcccgccctcctccgccaagacgccgagtgccgagcgcccgagcaccccggtccccagcgcccaacaagctagcaggctgcaagtatgcgctctttgttgatgcgtccaaggagttgagctgaatgcccagaatgctaccaggctgcaaaaactgaaggaaaaggcggcattcacgaacccggatcagttctattttaaaatgatcaacagtaggactgttggtggcattcatacacctaagcctgaatataataagtatactgaagcagaacttct

SEQ ID NO: 40758 - DNA, 712 bp, Zea mays
  misc_feature: Ceres CLONE 1434400-F
  misc_feature: Encodes the peptide sequence at SEQ ID NO. 40759
ggagctccccgcggtggcggccgctctagaactagtggatcccccgggctgcaggaattcgcacgagaccattacctagaacatcctaatcgaaaaacaacacgtccgcatactcccaaccaaatctccctccagcgccgcagctagcccgagaagccgacgaggaggaaaccgaccgccgacgccgagcaccctcggttccttgcttgcccggcgcccaatctagacagctctttctcgttcgtctgtatccatggccgcctcgagcaagaccatcgctgtcctcctcgccgcgctgctcctcgcgctggtcgcgtccgcggtggccagcaggaagctggaggaggaggacgctttcctgggaagcctttcgccggcgcctgcccccgccgagggcggagccgcggggctcgctagcggcacgccgggggcgtgggccgtcgccgctctggtctctctcatcgccttcctcgcgaactgagcgggtcctgcgatctggattgctgcgggcggaggggaacatttatgctcgccctgtttgttctaggctatcggttccagtgctgctgacctctcttttggctgtataagagaggattacgcaccgtttcattttatactacttatctgttaatctgttaaaaaaaaaaaaaagcttatcgataccgtcgacctcgagggggggcccggtacccattcgccctatagtgag

SEQ ID NO: 40759 - protein, 75 aa, Zea mays; identical to SEQ ID NO: 39098
  misc_feature: Ceres CLONE 1434400-F

SEQ ID NO: 40760 - DNA, 782 bp, Zea mays
  misc_feature: Ceres CLONE 1434401-F
  misc_feature: Encodes the peptide sequence at SEQ ID NO. 40761
  misc_feature (22)..(22): n is a, c, t, g, unknown, or other
  misc_feature (27)..(27): n is a, c, t, g, unknown, or other
  misc_feature (29)..(29): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (64)..(64): n is a, c, t, g, unknown, or other
  misc_feature (439)..(439): n is a, c, t, g, unknown, or other
tggggaggtgccccccccgggnttaanancaataagcgatccccgccggcnnnatcaaactggngctccccgcggtgggcggccgctcttactagcggagcccccgggctgcaggatctcgcacgagaccatggcctagaacatcctaatcgaaaaacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggcgccgccaagctctcgctcggcgccggcgggctctccctccccagctactccgactccgccaaggtcgcctacgtcctagaaggggtcngtacctgcggcctcatcctccccgacgcgaccaaggagaaggtggtggccgtgaaggagggggacgcgctggccctgcccttcggcgcgatgacgtgggggcacaacgggcccggcgcgcagggcgacctcccgggggctctttcttcgggcgacacctccaaggggccacaaagcgggggggcaggttccccaactttccaggttcaagcgggggcccgcggggcatcggttgaggggggcccggtcccccccaagttcccttgggtcccggccgccggtgggaaaatcttggccccgaaaacccccggacggcctgacgcaaggggctacggatcgtcccc

SEQ ID NO: 40761 - protein, 182 aa, Zea mays
  misc_feature: Ceres CLONE 1434401-F
  misc_feature (6)..(127): Pfam Name: Cupin_1 Pfam Description: Cupin
  misc_feature (69)..(69): Xaa is any aa, unknown, or other
MAAVDLTPRTPKKAYGGDGGAYYEWSPADLPMLAVASIGAAKLSLGAGGLSLPSYSDSAKVAYVLEGVXTCGLILPDATKEKVVAVKEGDALALPFGAMTWGHNGPGAQGDLPGALSSGDTSKGPQSGGAGSPTFQVQAGARGASVEGGPVPPKFPWVPAAGGKILAPKTPGRPDARGYGSS

SEQ ID NO: 40762 - DNA, 679 bp, Zea mays
  misc_feature: Ceres CLONE 1434404-F
  misc_feature: Encodes the peptide sequence at SEQ ID NO. 40763
aaactggagctccccgcggtggcggccgctctagattagtggatcccccgggctgcaggaattcgcacgagaccattacctagaacatcctaatcgaaaaagtcccaggagcgtggcctcactctcctcatcacatcccccctcctcatcttcgcagcgcgggcgggggcaatggcgatggcctccacctacgcgccgggcggaagcgcgcgggcgctcgcgcacggtaccatgcaaggtccgcggtcccgcggggctgggcttcctcggccctctccaaggccgacgggctccccagccccctcgccctcgccagggggatgagcagccccgtcgcggtgggcgccaagctgcaatgcgcggtgtcatcttccccagcggaggcgcggcccgccacggggctacgcttcatccagtacaagaacgaggccttctggttcaaccgcttcctctccatcgtgtacgaccacgtcatcaatccgggccacaggaccgaggacatgcgcgactacccactggaacctgccgagctcttcagccgcaccctcacggtcatcgacttcggagacaacacagtgttaaccccgactcggaatgttcaatcatttcaacaggaaaaggtaacccttgttaaaccagttccccggaccatctcaacagtgccctgccaaaacggagg

SEQ ID NO: 40763 - protein, 119 aa, Zea mays
  misc_feature: Ceres CLONE 1434404-F
MSSPVAVGAKLQCAVSSSPAEARPATGLRFIQYKNEAFWFNRFLSIVYDHVINPGHRTEDMRDYPLEPAELFSRTLTVIDFGDNTVLTPTRNVQSFQQEKVTLVKPVPRTISTVPCQNG

SEQ ID NO: 40764 - DNA, 721 bp, Zea mays
  misc_feature: Ceres CLONE 1434406-F
  misc_feature: Encodes the peptide sequence at SEQ ID NO. 40765
tctgaattcgtggatcccccgggctgcaggaattcttacgagaccattacctacaacatcctaatcgaaaaagcaagaaattgtcaacccactctatcttatctctctttgattgccatgtacgtcaccacttaaaagcttgtgacgcttgtgatatgagcaatgaggtggatgtatcctctcttgaggccggcggcgaccgtgaccttgactacgctgaccctccgccggcaccgctgatagaaatcgaccagctcgccaagtggtccctgtaccaccccgtgatcgcctaattcgtggctgcgctcctattcttgtaaatcacgattgccaaggggataaggtatgatgaccagaatgaaacctctgttcttggacaatactctgctcgccacccccagggcattgtggtgaaagcgtagtcactacgcaatccgcatgtcctcctcccctactgcgcatctggggcttagagcgaaaataatactcctgccaggtcaatcgaatccttacttgagcctaatgccttcgtggtgcgctctcctgctgaacatagccgcccagaagcctcgtagttccctgccgaaataacgtctcatcaaaggtcttcccgaattttccttcaaaaatgcttttacgtatcccccgaaacaaaaataacacaaggcgtcgggcaaaacaccacatgttcctttggtctcccccacccctaaaaacagcg

SEQ ID NO: 40765 - protein, 45 aa, Zea mays
  misc_feature: Ceres CLONE 1434406-F
MSNEVDVSSLEAGGDRDLDYADPPPAPLIEIDQLAKWSLYHPVIA

SEQ ID NO: 40766 - DNA, 921 bp, Zea mays
  misc_feature: Ceres CLONE 1434406-R
  misc_feature: Encodes the peptide sequence at SEQ ID NO. 40767
  misc_feature (125)..(125): n is a, c, t, g, unknown, or other
  misc_feature (126)..(126): n is a, c, t, g, unknown, or other
  misc_feature (135)..(135): n is a, c, t, g, unknown, or other
  misc_feature (184)..(184): n is a, c, t, g, unknown, or other
  misc_feature (368)..(368): n is a, c, t, g, unknown, or other
  misc_feature (921)..(921): n is a, c, t, g, unknown, or other
cgattgggtacgtcgagcgtctcgtgagacgattcctgcagccccgttgatccactagttctagagcggccgccaccgcggtggagctccagcttttgttccctttagtgagggttaattagcannccccacccnactgcacctaatccaacaatcacacccaaaccaacacctcccaatccancctcaccataacacccaccaacaacaccttcttccactgccacctaaacaacacaaccctctccagctctaggttcacctcgaagctcactacggacaaccgcacctgggatctatcgggataggacgggctcgcgctacgcatcaacgggtcggacgggcagcggtacatgttgacgcttaangacaaggaactgccgaagtgggccgacggcccccaccagagcacgctgagctgggagtatgattttcagccttccgctgggattgcgggaggtaaagagagggtttcggtgaaatgtgcgggatttaaaggctaattatccttgccccgtataaggacgatgcggaaacattggcattttgaaacggggaaaagaggtagactggttaggattgcggagcttcgctctggaaaaaaagaaggaagacttgacaagcttggggattgtgataatatatgaagacgctgtcggaaagcaacgggaataagagaggtgatagtcaaaacagtactttctgggaatcttgaagcactggaatttaggaagaagaattactgtgatatgaaaaggggtcaatacaaggaatacaagggctggaatatggggttcttggagaagcttggggattattaagaatactcccaaaatgcgataagaatatgagtaactatatgaacggatatcgcacgctgtatggtggaatgaaaaaaccccctcctatagcacaccccgn

SEQ ID NO: 40767 - protein, 49 aa, Zea mays
  misc_feature: Ceres CLONE 1434406-R
  misc_feature (5)..(5): Xaa is any aa, unknown, or other
MLTLXDKELPKWADGPHQSTLSWEYDFQPSAGIAGGKERVSVKCAGFKG

SEQ ID NO: 40768 - DNA, 591 bp, Zea mays
  misc_feature: Ceres CLONE 1434411-F
  misc_feature (203)..(203): n is a, c, t, g, unknown, or other
  misc_feature (219)..(219): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (278)..(278): n is a, c, t, g, unknown, or other
  misc_feature (280)..(280): n is a, c, t, g, unknown, or other
  misc_feature (281)..(281): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (434)..(434): n is a, c, t, g, unknown, or other
  misc_feature (468)..(468): n is a, c, t, g, unknown, or other
  misc_feature (518)..(518): n is a, c, t, g, unknown, or other
  misc_feature (559)..(559): n is a, c, t, g, unknown, or other
tggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgaacaccatngagggagtgcatttcngatccacagtcggccagggccggggtaatccagggtcgggaaaaaccgcgttgcnnncncnntnnnntgggggaagcctggtaaacttgggccccctttggggaaaggcccattggggcccaaattttccaggggcctttgaaacgggggtcccaaaaaaatgggnnnnnggggggcgcgggccgcccccccgccgcgcgcgccgccgccgggtncgggcggggggggcgggggggggagagctctgcnttggcggggggggggggcggggtggggggggcggggtgggttggtgggtntgggacaaccacgtccccacgaagaggggggggggagggangcaaccccccccccccaccttctgttgttttt

SEQ ID NO: 40769 - DNA, 703 bp, Zea mays
  misc_feature: Ceres CLONE 1434412-F
  misc_feature: Encodes the peptide sequence at SEQ ID NO. 40770
ggcggccgctctagaactagtggatcccccgggctgcaggaattcgcacgagaccattacctagaacatcctaatcgaaaaattcgcaccaccgccgcgccgcccaaatcacagccaccgccgccatggccgcctccagccgccctctcgtctccgtgaaggccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctggggtacgggccgcgctgtgtcccgtatcccccgcgtccccggcggcggcacccaccgcgccggccagggagcattcggcaacatgtgccgcggcggacgcatgttcgcgcccaccaagatctggcgcaagtggcaccgccgcgtcaacgtcaacctccgccgcgtcgccgtcgcctcggcgctcgccgccaccgccgtcccggccctcgtccaggcgcgcggccaccgcatcgagaccgtcccagagatgcccctggtcatctctgactcggcggagtccatcgagaagacctcccaggcgctcaagatcctcaagcaggtcgggcgctacaccgacgccgagaagccaaggactccgtcggcatccgc

SEQ ID NO: 40770 - protein, 192 aa, Zea mays
  misc_feature: Ceres CLONE 1434412-F
  misc_feature (23)..(192): Pfam Name: Ribosomal_L4 Pfam Description: Ribosomal protein L4/L1 family
MAASSRPLVSVKALEGDMVTDAPGIALPPVFGAPIRPDVVRFTHKLLSCNKRQPYAVSRRAGHQTSAESWGTGRAVSRIPRVPGGGTHRAGQGAFGNMCRGGRMFAPTKIWRKWHRRVNVNLRRVAVASALAATAVPALVQARGHRIETVPEMPLVISDSAESIEKTSQALKILKQVGRYTDAEKPRTPSAS

SEQ ID NO: 40771 - DNA, 669 bp, Zea mays
  misc_feature: Ceres CLONE 1434414-F
  misc_feature: Encodes the peptide sequence at SEQ ID NO. 40772
  misc_feature (669)..(669): n is a, c, t, g, unknown, or other
tcaccgcggtggcggccgctctagaactagtggatcccccgggctgcaggaattcgcacgagaccattacctagaacatcctaatcgaaaaatccgttctgttgaaaattaaaagacgtgcgtgactcccatctatagagtacagagattcaaaacaatggacttgtactaaaaactagactacctccgcggagagggatagaaagatgcaaaacgaccttctcctgtcctgcatctgcatgcaataagcagccgctttagtgctgccgtgcagagaggtacttccatgctgctcctggccgtgccggccgtgttggccgggttcctcaaggcgttccgcctcgccttcctgctttggccgctcaacctcgcgctcccgctggcgcgcgacctgccgcgggcctgcatcacggtccgggccatcgcgtccttctacgccgccgggctgcggggctacgtcgccggcgcccaccgcggcgtgcagctgctgcaggcgcgaagccagctgggccaacagcaacagctggacgccgccgccgcctcctcctcttcttcctcctcctcggggctcggagtggccgtgaacccccgaggatgccaatggtggtccccaatgccatgctctcccttcgacaaattctactgattgatctggcagggggaccttcn

SEQ ID NO: 40772 - protein, 119 aa, Zea mays
  misc_feature: Ceres CLONE 1434414-F
MLLLAVPAVLAGFLKAFRLAFLLWPLNLALPLARDLPRACITVRAIASFYAAGLRGYVAGAHRGVQLLQARSQLGQQQQLDAAAASSSSSSSSGLGVAVNPRGCQWWSPMPCSPFDKFY

SEQ ID NO: 40773 - DNA, 882 bp, Zea mays
  misc_feature: Ceres CLONE 1434415-F
  misc_feature: Encodes the peptide sequence at SEQ ID NO. 40774
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
gggtatttggttttatattaaaagcnnnnnnnnnnnntannnnnnnntaagctggagctccccgcggtggcggccgctctagattagtggatcccccgggctgcaggaattctcacgagaccattacctagaacatcctaatcgaaaaatatgagtcgttgcctcgcagtttatatccctactgtttcggactttcgggttttggccgacacccgacaatcttaacatcaaactcgtcgtccacgcctcctcggcaaggttgcgtacggcgtggccctaaggcataccagcgggatcaagctattttgctggccaaccgaacggtcaagccgacgatgacgctcggatcggcggcacacaagatcccgctggaggttgcgcacaccctcgtcgagatcgccgaggtcgcgcgctacgcctacaagcaccccccccggccgccctgcaaccccggaggggggaccctaactgcccccgccccgcaggggcttgataggaaacgggggggcccaaacaagggattgcccccgccggctgctgggaaggaaaaatgcctttggttcccgcgccccgaaactcggaaaaaggaaccttcaggccttcttggcggtggagactcctccgggaggcgccccttggggttctccccagggggagggccccctccctgtggatcctcccaccacacccggattggaggtgcgggggggggtccacacgaatgggtttgggctttgcgtcggggcggtttcccccgtagaaaacatttaccgggaatataatagtcctctctcaggttcgagttgtgaggctggagtataacttttccctgggcgctatcatataacataaagaggtggtaagccagttgagcggtaagct

SEQ ID NO: 40774 - protein, 148 aa, Zea mays
  misc_feature: Ceres CLONE 1434415-F
MTLGSAAHKIPLEVAHTLVEIAEVARYAYKHPPRPPCNPGGGTLTAPAPQGLDRKRGGPNKGLPPPAAGKEKCLWFPRPETRKKEPSGLLGGGDSSGRRPLGFSPGGGPPPCGSSHHTRIGGAGGGPHEWVWALRRGGFPRRKHLPGI

SEQ ID NO: 40775 - DNA, 792 bp, Zea mays
  misc_feature: Ceres CLONE 1434416-F
  misc_feature: Encodes the peptide sequence at SEQ ID NO. 40776
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
tttttttttttnnnnngngnnnaactatctctgnnaaaaaanaaaaaaaactggtactccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttccacctgaggatgcccttttcttcctcgtaaacagtgtacccccacccagcagtgccaaccatcggttcactctatcaggagccaccatgaacaggacttttttcttggacattgccttaccgggatgagcaagggttatggaaaattttaactttaaccccctaacctcccgcccgggattttccaaagccaaatccaccaaattggaaaaaatccaaccaaaagctttaaaaccctacttaggaaacccttacaaaaaaaaatttaaaaaacccctcggaagggatctggcttatttaaaaagggaatcttaaatttattggggaaagggttttttcctccccccccttttggactgag

SEQ ID NO: 40776 - protein, 112 aa, Zea mays
  misc_feature: Ceres CLONE 1434416-F
  misc_feature (13)..(102): Pfam Name: MAP1_LC3 Pfam Description: Microtubule associated protein 1A/1B, light chain 3
MKFQYKEEHAFEKRKSEGEKIRRKYPDRVPVIVEKAPKARIGDLDKKKYLVPSDLTVGQFYFLIRKRIHLPPEDALFFLVNSVPPPSSANHRFTLSGATMNRTFFLDIALPG

SEQ ID NO: 40777 - DNA, 895 bp, Zea mays
  misc_feature: Ceres CLONE 1434417-F
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
gtgggtggggttaataaaaaaatcctctcctctcccgccccccnnnnnnntnnnnaaagctggagctccccgcggtggcggccgctctataatagtggatcccccgggctgcaggaattcgcacgagaccattacctagaacatcctaatcgaaaaaactactccgtcactttgtttgcaaagctcctcctcgatccatcgatcactgcaccggccggcggccccgcgctcgcacgggctagccaaccagacggccgcaatggcggaccgtgaccggattggaatctaggggggggcccatatcaccttacgggggccaccgcacccggcaggaggccggcgcccaatggttgatcctgttcaagccgccgctcccccgacaaggggccgaaggccgtcccatggctttgacggtggactaaattttatttataaattcaccccacgcctaccacgtgatcgcctctccagagcgcgtgcgcccccgcaccccctgtttatgagcggggggcccaaacacctctggccccagcggcgggggggttccccctttacatgcactacacgcccccgcatctgctttcgcagccccctgccaccgcgaacggcctctcccccccacgccctgctctcctttattgaagtggcttgcccgccccgcccccccgcggcccctaccttaagcgtatttggtggctgaggccgcgcctctacccgactccccggggggtcagtgcaccaaacagtataatcaggtatacatgcatataatctcatggcccaccccccccggaatatccttgtttgtggccctgtctcctcccactcttctcttataaccgctgtaggcgtgtgtctgggggggtggtggaagtatcgcggggcgccgagcaaa

SEQ ID NO: 40778 - DNA, 690 bp, Zea mays
  misc_feature: Ceres CLONE 1434418-F
  misc_feature: Encodes the peptide sequence at SEQ ID NO. 40779
  misc_feature (540)..(540): n is a, c, t, g, unknown, or other
  misc_feature (618)..(618): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (678)..(678): n is a, c, t, g, unknown, or other
gctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggtgatggaactacnactgcctctgttctcgctagggagatcatcaaattgggcatggtgagcattacttcaggggcaaatccagtgtccgtnaagaagggcattgataagactggtcagaaaattggtggaggactgannnagaaatcaggncgtcccaggggg

SEQ ID NO: 40779 - protein, 185 aa, Zea mays
  misc_feature: Ceres CLONE 1434418-F
  misc_feature (177)..(177): Xaa is any aa, unknown, or other
  misc_feature (178)..(178): Xaa is any aa, unknown, or other
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMVSITSGANPVSVKKGIDKTGQKIGGGLXXKSGRPRG

SEQ ID NO: 40780 - DNA, 715 bp, Zea mays
  misc_feature: Ceres CLONE 1434420-F
  misc_feature: Encodes the peptide sequence at SEQ ID NO. 40781
  misc_feature (515)..(515): n is a, c, t, g, unknown, or other
ggagctcaccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggngcggcgccccgacgcgccctgctgcccggagctggcgggcctcgtcggctccaaccccgtctgcctctgcgagctcctctccggcgcccgcgactcctaacggaatcgccggtcaactagggccggggcgctcgcggcttccccgggggtctggccggggtaaccaacccccgcccgttttccaccttggcaaggggctt

SEQ ID NO: 40781 - protein, 110 aa, Zea mays
  misc_feature: Ceres CLONE 1434420-F
  misc_feature (78)..(78): Xaa is any aa, unknown, or other
MVVAAMRRPCAVPALLVAAATATLALLLLLSPSSAQPMPSSPAAAPGPAGGTGIDSACLNSLLNMSDCLPYVSQGSTXRRPDAPCCPELAGLVGSNPVCLCELLSGARDS

SEQ ID NO: 40782 - DNA, 824 bp, Zea mays
  misc_feature: Ceres CLONE 1434424-F
  misc_feature: Encodes the peptide sequence at SEQ ID NO. 40783
  misc_feature (1)..(1): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nttttcccccccccccccccccccccccnnnnnnnggggggnnccnnnnnnnnaagctgggactccccgcggtggcggccgctctagaatagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcaccagcaccaggaaggaggcggccgcccgatgggggagcaggtgaagggcatgctccacgacaagggggccgacggcgtcgcaggcgctgaccgtggccaacgctgtttcccgctgggacgggctacctgctggtggcttgaccggggttggcccctaacgccccccccaggggaggggtagcccgagcacagggcggggggttctcaaatccttccccccccggggcttggccgccccgccgcgccttggctcctgcggggacgggccggagaaagggggggtcccccaacgcgccggcgccgccctggggcggtgcagggggaccttgggcccgcgtggccggggtgcctctcgcagaaccggggcgccgtagaacggcgtttccaacgggggcctcgccgtgagcatcgctgtcaaggggagggtccaccccccgcggagagtgtgcggaggggtcctgctgagttgcaaatccgggcacgaacagaagcgcgcctgtgggtgagaa

SEQ ID NO: 40783 - protein, 79 aa, Zea mays
  misc_feature: Ceres CLONE 1434424-F
MADRDRSGIYGGAHATYGQHQHQEGGGRPMGEQVKGMLHDKGADGVAGADRGQRCFPLGRATCWWLDRGWPLTPPPGEG

SEQ ID NO: 40784 - DNA, 699 bp, Zea mays
  misc_feature: Ceres CLONE 1434425-F
  misc_feature: Translation starting site: 176
ccccgcggtggcggccgctctagaactagtggatcccccgggctgcaggaattcgcacgagaccattacctagaacatcctaatcgaaaaagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcaacgcgatcatcaacagtggcccccgtgaggatgcccaccgtattgttccgcctggtgtgtgagagggcaggccgtggatatctcacccctgaggagggtgaaccagccatctacctcctcacactgtggccaggaggatggcttccggaactcaaaacatttgcgagggccttgcaaagaactgatcaccctggcaagg

SEQ ID NO: 40785 - DNA, 962 bp, Zea mays
  misc_feature: Ceres CLONE 1434426-F
  misc_feature (9)..(9): n is a, c, t, g, unknown, or other
  misc_feature (10)..(10): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (29)..(29): n is a, c, t, g, unknown, or other
  misc_feature (31)..(31): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
ccccccccnngcgggggggnnnnnggnancnccacccnnnccgnaaaaaagcaaatccccgcggtggcggccgctctatttttcgtgaatcccccgggctggaggaatttttacgagaccattacctagaacatcctaatcgaaaaatcgcaaatcctcgctcgggcaagaagagccaactgaaaagtattcatccaagaacaccaccccacccgctccaagcagaagtttcgtcttgaagagagccgccaccaccaagggcttgttacaacactgcatctttagcggggactctgctggcgttcgcgctgacgtttcaggcctgcctcgccgggaggaggctcaccgcgctggtgcaggagccggccatagtcttgaggtacctcggggggcgcccttccggtccggggcctatgggccgtgtggtttaatcttggtaccggccaactttctgggggggctgtaaaaagtcggtgtcgaactacctttttttataaataattacgttgactggggggtgggccactcggaccgccacgccacaaccccggatggcgatggtcgcgaggggggtgcggatgggttccgcagcccagtgggtgggcgaggggggaagactaagggcggcgggcgaacgacaaacgaacaacaatataactacatgagcatttttctgcctctgacgggaacacgggaggagggagagtcaccacctggtggggtctgctatcctcgtgtgtgctggggtcgtcccacttctcacatgctcattgggaactctctagtacctaccccgctcgcggcggagcacgggtgacccaggtcgcatgtcccggcacctctcggtgcacggcgggggggcggcgccatctcgcgcgcgtgtccatcgaggcgggtctgtcatgagcgtgtcgcgcgtgcgtcgccccaactgcgcgcgcagacaaaataaggcacacacg

SEQ ID NO: 40786 - DNA, 826 bp, Zea mays
  misc_feature: Ceres CLONE 1434428-F
  misc_feature: Encodes the peptide sequence at SEQ ID NO. 40787
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
ccccttggtgggnnacnnnnnggagctnnttttccccnnnnnnccaaactgggactccccgcggtggcggccgctctagattagtggatcccccgggctgcaggaattctcacgagaccattacctagaacatcctaatcgaaaagttcccctctctcttccccgtcctgcaggctccaggcgctgctgctctcgtcctccgctagcgagcgaatcgctgacgctggcccgacgccgcggcgggaggtatctcgctttcgatcaggattttggttggggcgtcgttctccggtgcttatctcatttctatttatcggtgcctcgggttcacggccaaattcgctgctgcgtggggctttggagattggagccgattccttaaagtggcggtggcagcgtctggtgagaaccatgagcttcgtgttccaaggaagcagggccaacatccaggccggtggcttcacacgccccgcccccgagcgccgcaccatggcaacttcttgcagggagcagggccggtgaaacaccaattcccctgggtttttcctcccaaccggtttttgggtttgggccagggacctcaaactccccaccaaaaggccccccccaaccttttcgccttaggaaaagtcttgggagaccccttccttaatggcccccgaacccttataagagtggtgcccccctcgccagccagccttgcttcatgtgttccaacccccccccaaccgtttttctttggtgcccaccctggaagccttgggggggggcctttgaaccccccccaaacccattgccctctgtcgaaaagaaaaaggtccaattt

SEQ ID NO: 40787 - protein, 36 aa, Zea mays
  misc_feature: Ceres CLONE 1434428-F
MSFVFQGSRANIQAGGFTRPAPERRTMATSCREQGR

SEQ ID NO: 40788 - DNA, 743 bp, Zea mays
  misc_feature: Ceres CLONE 1434431-F
  misc_feature: Encodes the peptide sequence at SEQ ID NO. 40789
ggcggccgctctagactagtggatcccccgggctgcaggaattcttacgagaccattacctagaacatcctaatcgaaaaaccattcctttctctccctctcgccgtcgtcgccacctccacttggccccgctcatcgcctcctccgacgaccaccgtccaccggcgacaaggacagcgacgatgcagtcggcggcgtggaggcgtcacctcctcgaccaccacctctccccttcaacctcggctgccatcgccgccttcagatccgcctcccagcccgggctcgctccccaagggttgtttggagcggatggcgcaagatgcatgtctgcgagggcgccggcggtcaaggggtccgggcatctcgtccgcaagggcaccggagggaggtcttctgtgagtgcaattgtagccacggtgttttggagctcctgggttttcttgggcccctttctttgggcaaccaacttgccaagatgggggtctccaggtgctttgtcccatttcaaagggtggtgaggattcctccccccccccctggaagattaaggggtggaccttgggtccaattggggccccatggaaatccccctccgcaaggaagggtggattctcatttaagggctgttatgggcccaagccaaattgtgggttttttaacccctcctaaggcccaggagttttgaaaaccaggggacctccccccttttcaaaaaaagtaaaacccccctttttgccttgaaa

SEQ ID NO: 40789 - protein, 111 aa, Zea mays
  misc_feature: Ceres CLONE 1434431-F
MQSAAWRRHLLDHHLSPSTSAAIAAFRSASQPGLAPQGLFGADGARCMSARAPAVKGSGHLVRKGTGGRSSVSAIVATVFWSSWVFLGPFLWATNLPRWGSPGALSHFKGW

SEQ ID NO: 40790 - DNA, 689 bp, Zea mays
  misc_feature: Ceres CLONE 1434437-F
  misc_feature: Encodes the peptide sequence at SEQ ID NO. 40791
  misc_feature (535)..(535): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
cgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccaacaactttgcccgtggtcactacaccattggcaaggagattngtgacctatgccttgatcgcatcaggaagcttgccgacactgcactggtctccagggctcctcgtcttcacgctgttggtgaagaacgggctctgctgtctctcaagcctgtttacgacatgttcgtannnnnnnnnnnnnnnnnnnnnnnnnn

SEQ ID NO: 40791 - protein, 157 aa, Zea mays
  misc_feature: Ceres CLONE 1434437-F
  misc_feature (49)..(160): Pfam Name: Tubulin Pfam Description: Tubulin/FtsZ family, GTPase domain
  misc_feature (115)..(115): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIXDLCLDRIRKLADTALVSRAPRLHAVGEERALLSLKPVYDMFV

SEQ ID NO: 40792 - DNA, 836 bp, Zea mays
  misc_feature: Ceres CLONE 1434438-F
  misc_feature: Encodes the peptide sequence at SEQ ID NO. 40793
ctttgccccctccctccccgcccgcctcttttttctgttggttttggttatgttggagctccccgcggtggcggccgctctagaactagtggatcccccgggctgcaggaattcgcacgagaccattacctagaacatcctaatcgaaaaaatcaagtcggagcccgcaggtgtcgacaccgcgcgccgggagccggaagaagggtggggggtgagctgtggaccatgagcgcgaccgggcgagccccgtgcggcctgccgcgcatcggcctgggcacggcggtgcagggcccgcggccggaccccgtccgcgccgcggtgctgcgcgccatccagctcggctaccgccacttcgacacggccgcgcactacgccaccgaggcgcccatcggggaggccgccgccgaggccgtgcgcacggggctcgtcgcctcccgcgaggacctcttcgtcacgtccaaggtctggtgcgccgacgcgcaccgggacagggtgctcccggccctccgccggacgctcaccaatctccagatggaataacgtggacctgtacatggtgcactgggcccgtgaccatgaaggcccggagtttcacgcccccccttctcccccgatggaccttctaagcctttccaacatgctcgggcccgggtgggaaggcccatggaaggagggcccaccccccttgttgccatggcccaagggccgtgcggcgggtgcggccaactccgctccccgggccaaggaatgcttctaggaaaccctgtgatcctcccgtttgggcccagcgattcccccgtccccccggtggattcacaccccacgctcatacaata

SEQ ID NO: 40793 - protein, 104 aa, Zea mays
  misc_feature: Ceres CLONE 1434438-F
  misc_feature: SWISSPROT Homolog: EC 2.3.1.170 6'-deoxychalcone synthase
MSATGRAPCGLPRIGLGTAVQGPRPDPVRAAVLRAIQLGYRHFDTAAHYATEAPIGEAAAEAVRTGLVASREDLFVTSKVWCADAHRDRVLPALRRTLTNLQME

SEQ ID NO: 40794 - DNA, 736 bp, Zea mays
  misc_feature: Ceres CLONE 1434440-F
  misc_feature: Encodes the peptide sequence at SEQ ID NO. 40795
  misc_feature (616)..(616): n is a, c, t, g, unknown, or other
agctccccgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgcggtggaccacctgtcgcagtactcgggcgagggcggcggcggtggcatgctgtacgtgcccggggcaagtggctgacgggccccttcaacctgaccagccactttcaccctctacctccaccaagacgccgtcatcctcggctcccaggacgtaggcgagtggccaatcgtggatcccctgcctccttacggaagagggagggacaaggtcngagggaggttcgctagcctcctcgggggatcgaacctgaccgacgtagtcatcacgggcagcaacgggacgatcgatgggcagggcgccatgtgggggtcaagttcccacagacccagct

SEQ ID NO: 40795 - protein, 105 aa, Zea mays
  misc_feature: Ceres CLONE 1434440-F
MAPRTLGFNAAPLLQILRSLCLLALAAAAAVSGRRHGASPARGSGQSMYLAPACRAHTASVADFGGVGDGTTSNTAAFRSAVDHLSQYSGEGGGGGMLYVPGASG

SEQ ID NO: 40796 - DNA, 714 bp, Zea mays
  misc_feature: Ceres CLONE 1434448-F
  misc_feature: Encodes the peptide sequence at SEQ ID NO. 40797
  misc_feature (427)..(427): n is a, c, t, g, unknown, or other
caaagctggagctccccgcggtggcggccgctctagaactagtggatcccccgggctgcaggaattcgcacgagaccattacctagaacatcctaatcgaaaaacttcacacccagcgcactcgagctcgagccctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcaggnttgcccaatggatgcttcaaactcctggtgcaacaggttacatgggatgcattgaaaaggacaagtttggtaaggaaatgagaaaaaccctccagctgccggagttactggtccttactccgaagataaaactgctcctactgccaatggccttaatttttttttggggggaaaaggcctttttttcaaatttttcccgggaaaatgtttaaattttggccttaaaaaccccaaaaattggccctttttaaaaggaaaaaccccccgtggggggttttccccacggt

SEQ ID NO: 40797 - protein, 140 aa, Zea mays
  misc_feature: Ceres CLONE 1434448-F
  misc_feature: SWISSPROT Homolog: EC 2.7.1.20 Adenosine kinase
  misc_feature (71)..(71): Xaa is any aa, unknown, or other
MAATEGVLLGMGNPLLDISAVVDDAFLTKYDIKLNNAILAEEKHLPMYDELASKSNVEYIAGGATQNSIRXAQWMLQTPGATGYMGCIEKDKFGKEMRKTLQLPELLVLTPKIKLLLLPMALIFFWGEKAFFSNFSRENV

SEQ ID NO: 40798 - DNA, 685 bp, Zea mays
  misc_feature: Ceres CLONE 1434449-F
  misc_feature: Encodes the peptide sequence at SEQ ID NO. 40799
ggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtcgggcgcgctggggctcgggggcctgtcctcgctcacgtgcctcgcccacacggcgcggcaggcgttcccacccaccccggactacgtgggaggaggccccccgcaggatggcggaaggccgcggccgcacgcgggccaaaaaaacggcgcaggcaggcccagcccatccaggggcaggccg

SEQ ID NO: 40799 - protein, 167 aa, Zea mays
  misc_feature: Ceres CLONE 1434449-F
  misc_feature (44)..(161): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSGALGLGGLSSLTCLAHTARQAFPPTPDYVGGGPPQDGGRPRPHAGQKNGAGRPSPSRGRP

SEQ ID NO: 40800 - DNA, 707 bp, Zea mays
  misc_feature: Ceres CLONE 1434452-F
  misc_feature: Encodes the peptide sequence at SEQ ID NO. 40801
  misc_feature (495)..(495): n is a, c, t, g, unknown, or other
  misc_feature (501)..(501): n is a, c, t, g, unknown, or other
  misc_feature (562)..(562): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaaaaaccttcgctgctgcttcgcaacggtgccgcggcttcggacagggctctcgcgacgcgatcggccatggcggcgtctctgcgggcctcgtcctccctccgctcgcgcctcctctcgttctcctcggggtgttctctgtgtccgtggcgtctcctcctctcctcacctgtccactcggacgccccccaccagaccgaaaccctcgctttcgacgagatccagctgtcgccggagaagccggctaccgccactgccttcgtcctgcacggcctcctcggttccggccgcaactggcgctccttctctcgcgccctcgtctccgaactccgtaaccgctccccttcagacgagtggaggatggttctcgtggacttgaggaaccatgccagatcngctggnatcagggggctcggcccacccccacacatatctactgcccgcaaggaactcgctgatttanttgaagcccctggtgggcatgggccgaatgttgttggggtcantccctggttgaaaagtccctctaatttccggaagattccccccccgggggtttgaaattcgctaatctcccaaaaaccttgggccctaattttgccccgaaa

SEQ ID NO: 40801 - protein, 163 aa, Zea mays
  misc_feature: Ceres CLONE 1434452-F
  misc_feature (132)..(132): Xaa is any aa, unknown, or other
  misc_feature (146)..(146): Xaa is any aa, unknown, or other
MAASLRASSSLRSRLLSFSSGCSLCPWRLLLSSPVHSDAPHQTETLAFDEIQLSPEKPATATAFVLHGLLGSGRNWRSFSRALVSELRNRSPSDEWRMVLVDLRNHARSAGIRGLGPPPHISTARKELADLXEAPGGHGPNVVGVXPWLKSPSNFRKIPPPGV

SEQ ID NO: 40802 - DNA, 685 bp, Zea mays
  misc_feature: Ceres CLONE 1434455-F
  misc_feature: Encodes the peptide sequence at SEQ ID NO. 40803
  misc_feature (509)..(509): n is a, c, t, g, unknown, or other
  misc_feature (520)..(520): n is a, c, t, g, unknown, or other
ggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaaacgcgcgacgttctacttcctgggtgtccccatccctgccggcgtgntgggcgccgcntcaagctgccgggcgtgcaccacgtgcgcgcctggcgcacgacagcctggccacaacgccgcgtcgtcgctcatcgcctgggcatcacggcgctcgccttcgggctggcctgcagggaaatcacatcggcggacccgcggttgcccctgcccgtgctggaagcct

SEQ ID NO: 40803 - protein, 121 aa, Zea mays
  misc_feature: Ceres CLONE 1434455-F
  misc_feature (14)..(106): Pfam Name: AWPM-19 Pfam Description: AWPM-19-like family
  misc_feature (63)..(63): Xaa is any aa, unknown, or other
MAGIGRNMVAPLLVLNLIMYIIVIGFASWNLNHFINGQTNYPGVAGKRATFYFLGVPIPAGVXGAASSCRACTTCAPGARQPGHNAASSLIAWASRRSPSGWPAGKSHRRTRGCPCPCWKP

SEQ ID NO: 40804 - DNA, 716 bp, Zea mays
  misc_feature: Ceres CLONE 1434456-F
  misc_feature: Translation starting site: 156
  misc_feature: SWISSPROT Homolog: EC 3.1.2.22 Palmitoyl-protein hydrolase
  misc_feature (716)..(716): n is a, c, t, g, unknown, or other
aagctggagctccccgcggtggcggccgctctattctagtggatcccccgggctgcaggaattcgcacgagaccattacctagaacatcctaatcgaaaagctaactagaataggaatccgacgtcgcccccgcccccccctgtgaaaattcgtgatgcggagaacagctaccgccgccctcgtcctcgtccccctcctcgctgcggcggtacagacctccgccctgcctttcatcgtcctgcacgggattggggaccagtgcgtcaaccatggcgttgccaagttcactaaacttctcgccgattggtccggctccgacggctactgcctagagattggcagaggaacatgggactcttgggtcatgcctcttcaacaacaggctgatataatctgcaacaaggtcaaggaaatgaaacaactgagaggtggctacaacatagttggtctgtctcaggggaaacttgattggtcgagcagtgtttgagtactgtgatgatggaccgcccggtcaagaatttcatctctctaggaggtcctcatgctggtaccgcttcagtgcctctttgggtttctggatttttttgccttattgttgatgctctgatcaattgggagatctactcaaactatgtgcaggaacatcttggcacctaggggctacctcaaaatcccaactgatatgggcaattatccgaaaaagtgtagggttctn

SEQ ID NO: 40805 - DNA, 707 bp, Zea mays
  misc_feature: Ceres CLONE 1434457-F
  misc_feature: Encodes the peptide sequence at SEQ ID NO. 40806
cttgaactagtggatcccccgggctgcaggaattcgcacgagaccattacctagaacatcctaatcgaaaaaaaagtttcgtccaccatttcgctctcgcaagtcgcaagccaccgatttgtttacaggcttcggagctcccgacaaccctagactctgtcgcgccccgtcccctgcagcctgtgctctcgagctggagggaggtgagctgcgagggagcgcggagggggcgaggagatggaggcagattcggcgaggaacagacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaatccctggttggacgatcaacggcacggttgaactcatttcagcaggccaacaccagggtggcatgatcctgattgttccacagggggaccatgcagtaaggctagggaatgatgctagcgttgggcaggtggtggacgttgagaagggttcggagtatgctatcacattcagtgctgcccggacatgtgcacaactggaggcactgaatgttcccgtgctaggtggcgtgtctcagacagtagacttgcagacgttgtacaacatagaaggctgggatgcgtacgcgtt

SEQ ID NO: 40806 - protein, 156 aa, Zea mays
  misc_feature: Ceres CLONE 1434457-F
  misc_feature (49)..(156): Pfam Name: DUF642 Pfam Description: Protein of unknown function, DUF642
MEADSARNRLALLALLLLAAPVRPASAAPVEDGLLSNGDFETAPSGGFVKSASVAEGASSIPGWTINGTVELISAGQHQGGMILIVPQGDHAVRLGNDASVGQVVDVEKGSEYAITFSAARTCAQLEALNVPVLGGVSQTVDLQTLYNIEGWDAYA

SEQ ID NO: 40807 - DNA, 753 bp, Zea mays
  misc_feature: Ceres CLONE 1434458-F
  misc_feature: Encodes the peptide sequence at SEQ ID NO. 40808
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (21)..(21): n is a, c, t, g, unknown, or other
  misc_feature (36)..(36): n is a, c, t, g, unknown, or other
  misc_feature (37)..(37): n is a, c, t, g, unknown, or other
gtttggccgcgggngnngngncgggcgccccccccnnctcttcatttaccaaagggggagctccccgcggtggcggccgctcatgactagtggatcccccgggctgcaggttttcccacgagaccattacctagaacatcctaatcgaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatcctccgagggtggtgaggacgaaagcgttgatgacccagctgtgaaggtggttgatattgttgacacattccgtctaaaggagcaacgtccccccccacaagagatcatttgtgtcttacatcaaaaaatacatcaggaatctcactgctgcgttggagccagagaaggcggatggagttcaaaaagggtgtcgagggtgcaaccaagtttctccttagcaggctgaaggacccccaattttttgttggtgaagtccctggaaggatggaagcggcggggggaattccgcccattacaagggatgggggcccactaattccaaacttcccttctaattcccctcctgggcctttaaggaagaatcaacggggcttatggc

SEQ ID NO: 40808 - protein, 124 aa, Zea mays
  misc_feature: Ceres CLONE 1434458-F
  misc_feature (1)..(110): Pfam Name: TCTP Pfam Description: Translationally controlled tumour protein
MLVYQDLLSGDELLSDSFTYKELENGVLWEVEGKWVTQGPVDVDIGANPSSEGGEDESVDDPAVKVVDIVDTFRLKEQRPPPQEIICVLHQKIHQESHCCVGAREGGWSSKRVSRVQPSFSLAG

SEQ ID NO: 40809 - DNA, 718 bp, Zea mays
  misc_feature: Ceres CLONE 1434459-F
  misc_feature: Encodes the peptide sequence at SEQ ID NO. 40810
ccccgcggtggcggccgctctagattagtggatcccccgggctgcaggaattctcacgagaccattacctagaacatcctaatcgaaaaattttgttgagacctagatacgggcccttgctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcccgacccccaactcgttaaggaagggcaggtggtcatcagggcgaggaacctgaggaccaccgcacagttcatcccggccaagggcttcaaggcacgcaaggttttattaccccaacggaggaaaatggattaccttcatgttccagaggaaggacgcgcaagaagggtccggccagccttggttttctggatccaaacatgggcccttggacatgaatggaagacgaaaccctatcccatggataagtcccctccacaaccctttccatttgggcagtggggtgaaactttttttcttttttccgaggttttccgct

SEQ ID NO: 40810 - protein, 151 aa, Zea mays
  misc_feature: Ceres CLONE 1434459-F
  misc_feature (2)..(151): Pfam Name: DUF850 Pfam Description: Eukaryotic protein of unknown function (DUF850)
MAEDLVLDTAIRDWVLIPLSVVMVLIGVLRYFVSKLMRSPATSPSPDPQLVKEGQVVIRARNLRTTAQFIPAKGFKARKVLLPQRRKMDYLHVPEEGRARRVRPALVFWIQTWALGHEWKTKPYPMDKSPPQPFPFGQWGETFFLFSEVFR

SEQ ID NO: 40811 - DNA, 791 bp, Zea mays
  misc_feature: Ceres CLONE 1434461-F
  misc_feature: Encodes the peptide sequence at SEQ ID NO. 40812
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (37)..(37): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
cccccccnnnccnnnnnnnnnnnnncnncncccgggngnggggnnngggnnnnnnnaaaaactggggctcaccgcggtggcggccgctctagattagtggatcccccgggctgcaggaatttgcacgagaccattacctagaacatcctaatcgaaaacaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgtttggcagcaccccgaatcctgggccagtgccgtcgagttccctgaggcattcagggcaccccgaagggcaacgcccctacttgctccccctcaatggccagtcctttgcgggccgcaggtggttggcccgccagcctcagggcgggggggaagccctccggccccccgggtaccagagggggatctttccggggctttggggccctcccccc

SEQ ID NO: 40812 - protein, 39 aa, Zea mays
  misc_feature: Ceres CLONE 1434461-F
MASPLRAAGGWPASLRAGGKPSGPPGTRGGSFRGFGALP

SEQ ID NO: 40813 - DNA, 654 bp, Zea mays
  misc_feature: Ceres CLONE 1434467-F
aagctggagctccccgcggtggcggccgctctagaactagtggatcccccgggctgcaggaattcgcacgagaccattacctagaacatcctaatcgaaaaaatgcagcagtagccgtctgcctcctcgctttccctttcgtccgtacgccgccgcctcgcaccgccgacagtcctcagtccagaactccagatcgagcctccctctccccagatcgggtcctaggctacagcagcccgcgcatccgtcaccttcacaccgcgtggggtggtctctctccccctccccttctcgtggacgactgggtgggctaccgccgccctacgcagggtgccgagaactcggcgatttctgccccgggaaaaaaccgccaccaaatcaagcgcttaaaaggcgccctgggccggggaatacatggggggggggcgggggactaaaaccgtcttttttgggggggcccttcccccccaaaattctttaaaaatttttgggcggggttcttttaaagggccccagggggggtggggggttttttaagggatcttgttctctggggaggagggcccgttttttttagagaaaccctttgaaaaaaaccccccacaaaggcccccccttgagggattctctcctcccttgagaaaagggggcggc

SEQ ID NO: 40814 - DNA, 733 bp, Zea mays
  misc_feature: Ceres CLONE 1434468-F
  misc_feature: Translation starting site: 209
  misc_feature (605)..(605): n is a, c, t, g, unknown, or other
  misc_feature (666)..(666): n is a, c, t, g, unknown, or other
  misc_feature (667)..(667): n is a, c, t, g, unknown, or other
ctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtacggtcgncgcagcgagagcgcgggcaagtgccgggagaagtgcgagcgccaccaccgcggggactggnntggagagcagcgctgcctgatgactgagaaaccccgggagcgggaggaagaagggcgcatcggcgc

SEQ ID NO: 40815 - DNA, 681 bp, Zea mays
  misc_feature: Ceres CLONE 1434475-F
  misc_feature: Encodes the peptide sequence at SEQ ID NO. 40816
  misc_feature (665)..(665): n is a, c, t, g, unknown, or other
aagctggagctccccgcggtggcggccgctctagaactagtggatcccccgggctgcaggaattcgcacgagaccattacctagaacatcctaatcgaaaaaacagaacaggcctatgttcccatcgagtcgagacgagaccgtcctccgcccgagtctcgctcgctagctagggtttccaccaatggcggcgcccaccacctcccgccgcggccccggcggcgcccgcaacatggacgacgagaacctcaccttcgagacctccccgggggtcgaggtcgtcagcagcttcgaccagatgggcatcaaggacgacctcctccgcggcatctacggctacggtttcgagaagccctccgccatccagcagcgcgccgtgctccccatcatcaacggccgcgacgtcatcgcgcaggcccagtccggtaccggcaagacgtccatgatctccctcaccgtctgccagatcgtcgacaccgccgtgcgcgaggtgcaggctttgattctctcgcctactagggagcttgcttcccaaacagagagagttatgctggctattggggaccacctcaacgtccaagtgcacgcttgcattggtggaaagagtattggtgaggacatcaggaggctcgagaatggggtgcatgtcgtctctggaactccangcagagtctgtgatag

SEQ ID NO: 40816 - protein, 149 aa, Zea mays
  misc_feature: Ceres CLONE 1434475-F
  misc_feature (42)..(149): Pfam Name: DEAD Pfam Description: DEAD/DEAH box helicase
  misc_feature (145)..(145): Xaa is any aa, unknown, or other
MDDENLTFETSPGVEVVSSFDQMGIKDDLLRGIYGYGFEKPSAIQQRAVLPIINGRDVIAQAQSGTGKTSMISLTVCQIVDTAVREVQALILSPTRELASQTERVMLAIGDHLNVQVHACIGGKSIGEDIRRLENGVHVVSGTPXRVCD

SEQ ID NO: 40817 - DNA, 740 bp, Zea mays
  misc_feature: Ceres CLONE 1434476-F
  misc_feature: Encodes the peptide sequence at SEQ ID NO. 40818
agagctggagctccccgcggtggcggccgctctagaactagtggatcccccgggctgcaggaattcgcacgagaccattacctagaacatcctaatcgaaaaaaacgactccttcagttccgtcccgttcgtgaccacctccggtcccgggaggggcaggcccacgttcagggacaaggtccgagtcctgctttgatggcgaccgacgtggctgagactcccgcgccgttgggggatgcggccacagaggcacccgccgacgccccggcagcgcctgctgccgacgcgaagccggccaaagccaacaaggccaccgcgcctaagaagcgcgtcagcccgacccacccgccgtacgccgagatggtctcggaggcgatcacgtcgctcaaggagaggaccgggtccagaaatctatgagattgccaagttcagtggagtgaaagtgacaaggacaagttcccgccccaacttctccaaagcttctgaagcgttcagctcaagaaagctcgtcctcggggcggaaagttgaccaacggggaagaacttcttacaacctgtccctccgccgccccccaagccaaaccccaaggcccaaggccgcccccaaaaaacacccaaaaaccggccctaagaaagcccagggccttttcccaagactcaatttaaaacccccgcgcagggtaaacccccgccaaaaaacccaaaccccccccctaaaaccaaaagccggtattgcaccc

SEQ ID NO: 40818 - protein, 73 aa, Zea mays
  misc_feature: Ceres CLONE 1434476-F
MATDVAETPAPLGDAATEAPADAPAAPAADAKPAKANKATAPKKRVSPTHPPYAEMVSEAITSLKERTGSRNL

SEQ ID NO: 40819 - DNA, 707 bp, Zea mays
  misc_feature: Ceres CLONE 1434483-F
  misc_feature: Encodes the peptide sequence at SEQ ID NO. 40820
  misc_feature (408)..(408): n is a, c, t, g, unknown, or other
  misc_feature (431)..(431): n is a, c, t, g, unknown, or other
  misc_feature (465)..(465): n is a, c, t, g, unknown, or other
  misc_feature (486)..(486): n is a, c, t, g, unknown, or other
aaagctggagctccccgcggtggcggccgctctagaactagtggatcccccgggctgcaggaattcgcacgagaccattacctagaacatcctaatcgaaaaatctccagcggcttcttccaaagctccaactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccangcgtgagtgttctgattgaaccnactagcggcaacacaggcattggactggcctttnatgctgctaccagggcctacnaactaacactcaccatgcctggttccatgagcatggagagggagatctatttgagggcttttgggctgaccttgccctaccggacccttcttgggaagaaaagacctttcccaaaaccgaaaaaattcagaaaaccccccttcttctatttttttaaaaatttgaaacccccctcacccaaaaattccttaaaaccccgggcccaaaaattggaaaaccca

SEQ ID NO: 40820 - protein, 168 aa, Zea mays
  misc_feature: Ceres CLONE 1434483-F
  misc_feature (12)..(167): Pfam Name: PALP Pfam Description: Pyridoxal-phosphate dependent enzyme
  misc_feature: SWISSPROT Homolog: EC 2.5.1.47 Cysteine synthase
  misc_feature (69)..(69): Xaa is any aa, unknown, or other
  misc_feature (88)..(88): Xaa is any aa, unknown, or other
  misc_feature (95)..(95): Xaa is any aa, unknown, or other
MGEASPSIAKDVTELIGNTPLVYLNKVTDGCVGRVAAKLESMEPCSSVKDRIGYSMITDAEEKGLITPXVSVLIEPTSGNTGIGLAFXAATRAYXLTLTMPGSMSMEREIYLRAFGLTLPYRTLLGKKRPFPKPKKFRKPPFFYFFKNLKPPSPKNSLKPRAQKLENP

SEQ ID NO: 40821 - DNA, 769 bp, Zea mays
  misc_feature: Ceres CLONE 1434486-F
  misc_feature: Translation starting site: 289
ggctccccgcggtggcggccgctctagaactagtggatcccccgggctgcaggaattcgcacgagaccattacctagaacatcctaatagaaaactgcccagcccccgccccggtcgcggagccgtcgttctcgtctttcggtgactcgcgcgcgccagctcacttctctacttcccttccccagatctacctccattcttccctcaaaatcacagatctctctcggccccgtgcccagcgctccgaaaccctagcgcccccgcgggtgccaggccgcgagcgtcgccatgggcataccgttttcatggcacataccaggggagaggagccaagatcgggagcacgctcacttgttcctggctttccccgatccagggtttgcagagccgggtggttgaggcattacaacgcaaccacgtgtcaggtccatcaggttggttcgagaatgccccgatggaatggcatgggtccttgaacaatggagggcactttaacggaacgatttgcctttccgaaacttctgaaggcttaaccgacgccctaagctttgggaggaccctggaacccacttggatcagtggaaacaatgaggtgggagtgacttggctggcctccgccttccctggacagctgaaactcggacctgcgcaagctcgcagtcaacctgattccattccctcgcctgcacttttttatggtcgggtttgcgcactcacctcgcgtggctcgcagcagaccgggctctcactgtcctgagcaaccagcaga

SEQ ID NO: 40822 - DNA, 687 bp, Zea mays
  misc_feature: Ceres CLONE 1434487-F
  misc_feature: Encodes the peptide sequence at SEQ ID NO. 40823
  misc_feature (555)..(555): n is a, c, t, g, unknown, or other
  misc_feature (556)..(556): n is a, c, t, g, unknown, or other
  misc_feature (558)..(558): n is a, c, t, g, unknown, or other
aaagctggagctccccgcggtggcggccgctctagaactagtggatcccccgggctgcaggaattcgcacgagaccattaactagaacatcctaatcgaaaagcatcaactcaaccgaagggacgaccgagcggagtctagactcgagagcaacctcgacctcccggatctctctcccacccacgcctcgtcgccgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaggtgctatctccggtctcagggagtgttgagtgtttcagcaatggaagcaatcttggtctgagattgatgctgaaattatatttatgctgganncnggggagaatcccaatgaggctctaaggccccccccctggagggaacccgggatttccatgcattgaagggcaaaatctccttaaagatgcctcccttccaaatttgctggaaagccatttgaaaatcca

SEQ ID NO: 40823 - protein, 122 aa, Zea mays
  misc_feature: Ceres CLONE 1434487-F
  misc_feature (3)..(123): Pfam Name: Coatomer_E Pfam Description: Coatomer epsilon subunit
  misc_feature (114)..(114): Xaa is any aa, unknown, or other
  misc_feature (115)..(115): Xaa is any aa, unknown, or other
MASPDLLFNLRNLFYLGAYQAAINNSDVPGLDADAAAERDAIVFRSYIALGSYQLVISEIDSSAATSLQAVKLLALYLTGDKEVLSPVSGSVECFSNGSNLGLRLMLKLYLCWXXGRIPMRL

SEQ ID NO: 40824 - DNA, 733 bp, Zea mays
  misc_feature: Ceres CLONE 1434491-F
  misc_feature: Encodes the peptide sequence at SEQ ID NO. 40825
  misc_feature (426)..(426): n is a, c, t, g, unknown, or other
ctccccgcggtggcggccgctctagaactagtggatcccccgggctgcaggaattcgcacgagaccattacctagaacatcctaatcgaaaaaggaaagcaaagcgcttcgcaagcacaggcagtgatcggtaaccaaatccggacagtcttgagctctctcagtctcagcatttcagttcccagattcacatagccccagcccccaagtagcgaaatggcagctgctccgttcgcgattgccggccggctctcccccgttgcgcgcctcccggtccgcgcctggaggcccgcgcacgggtttgcgtcgtccgggagagccggctcgctcgccgtggcgtccgcggcgcaggagaacagggaacacagtgtcgacgtacaggtttagcaaaaccgcggcaacaggcaacagggcaaccccttgaanggcccccgggccgcgggaaaagccttgaaatttccccatccccgtttgggttatttatccaagtcccccaaagcggaaaatgcggcaaatgttggaacacaagggaaggggtgtttcaaaccccggggggtcccccaggggagacgggaggtcccggggaccacccgggaaaataccccggggggggaacttgggggagcaaaaaaggggggaaaattggttttttataggggggcctcccgccccaaaggggagggtgggggggggaagaaccccctgttttcccgggggggaaaaaagggggggg

SEQ ID NO: 40825 - protein, 56 aa, Zea mays
  misc_feature: Ceres CLONE 1434491-F
MAAAPFAIAGRLSPVARLPVRAWRPAHGFASSGRAGSLAVASAAQENREHSVDVQV

SEQ ID NO: 40826 - DNA, 552 bp, Zea mays
  misc_feature: Ceres CLONE 1434497-F
  misc_feature: Encodes the peptide sequence at SEQ ID NO. 40827
  misc_feature (262)..(262): n is a, c, t, g, unknown, or other
aaagctggagctccccgcggtggcggccgctctagaactagtggatcccccgggctgcaggaattcgcacgagaccattacctagaacatcctaatcgaaaacactccacgttccgtgtttccgactccggtgactccaccaccagcaacccgtgcagcgagcgcactccgaccatcgccatgtcgaggcgcggcgactgggtctacgagaacaacggcgggacctgcgtggccatcgccggcgctgattactgtgtcgtcngctgcgggacacccgcccctctcttggtaggatacagtatcctcacgcgtgatcactcccaagaatctgcgaacctgggctgaaaaaaaggggaaccgggcatccttctgggttttaaggggaaaattaagggtcctcgcaaaaaaaaaccttcccccccaaaaaaatttttttttcccccccccccgctaaaaaaaaaaggggggaggaaaccccccccccccccacgggggggaaaaaaattcccccccttcccccaaaaaaaaaaaccgccggggggagaaaaaaaa

SEQ ID NO: 40827 - protein, 54 aa, Zea mays
  misc_feature: Ceres CLONE 1434497-F
  misc_feature: SWISSPROT Homolog: EC 3.4.25.1 Proteasome endopeptidase complex
  misc_feature (28)..(28): Xaa is any aa, unknown, or other
MSRRGDWVYENNGGTCVAIAGADYCVVXCGTPAPLLVGYSILTRDHSQESANLG

SEQ ID NO: 40828 - DNA, 712 bp, Zea mays
  misc_feature: Ceres CLONE 1434501-F
  misc_feature: Translation starting site: 245
  misc_feature: SWISSPROT Homolog: EC 5.3.99.6 Allene-oxide cyclase
  misc_feature (445)..(445): n is a, c, t, g, unknown, or other
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcangagctgtacgtgtacgagatcaacgagcgggaccgcgagagccccgcgtacctgcgcctcagcgccaagcagaacggagacgccgctgggcgaatctgtccccttccaccacaaggtggtacaacggcagcttgaacaaggggttggcctcaccgcgggaatttggntggtaatccagaaggttccccaaccgaaaggggacccgtaaaaggccttttaaggtttctattcaaaaactccggcccttttcggggaagggcccaaccc

SEQ ID NO: 40829 - DNA, 712 bp, Zea mays
  misc_feature: Ceres CLONE 1434505-F
aaagctggagctccccgcggtggcggccgctctagaactagtggatcccccgggctgcaggaattcgcacgagaccattacctagaacatcctaatcgaaaacccttgcgttgcgagtcatttatatgtatgggtttacacctcccttccggttgtttgcgagcgagtccatgcaagggctctcctgcgtcttccgttctcatagcttatgttatactgaaaaatgacatattcatggtgatcctcctctctcaatcactgattcacgcttcctagccaacccacggttcctgccaatgccgccgcaggcgggaagactctcgtcgtcggattgcgagaacatgttagattcgtccttgtccaggacttgcctaacagacttgcagtcacacactggaattttagctgagggcataatgacctggaagcaagttatcattcggggtgttgatatgtttggagaacgattgtgtttatctgattcaaaacagagattttggacaaggtgtctggtcacaagggttctgggtattgtgtttgcaagaggaccagacgtacctgttctcattcccttggagtttgatgaaggggaaacttacgcggtcctcactgaacagggtcagggttcctactgggaaagattgtgctggaatttccctgctggggatgttggattgatgacccaaggtggattttgttggcccccccccac

SEQ ID NO: 40830 - DNA, 795 bp, Zea mays
  misc_feature: Ceres CLONE 1434516-F
  misc_feature (575)..(575): n is a, c, t, g, unknown, or other
  misc_feature (598)..(598): n is a, c, t, g, unknown, or other
  misc_feature (645)..(645): n is a, c, t, g, unknown, or other
  misc_feature (646)..(646): n is a, c, t, g, unknown, or other
  misc_feature (669)..(669): n is a, c, t, g, unknown, or other
  misc_feature (670)..(670): n is a, c, t, g, unknown, or other
ggagctccccgcggtggcggccgctctataactagtggatcccccgggctgcaggaattcgcacgagaccattacctagaacatcctaatcgaaaaaaaagatcgcgaagcgagagggaatgatggaggcataggcactagcacctcctcgactccacctccgtcctcttcgatcccgtccaatcccccgagccccggcgcccctctccgccggcggctttgctgggtcccgcgctcctcctcctcctaggctgttctggttggggctgcggcggagggaactaggtaaggggaaagaaaggggacgtttgagggagagcgcagcggcagctgcagcagcgatgccatcgcacgcggaattggaacgcgcagatctcgcaggtgcgggattgcaaattccttgcctgaagccaaggccaaaaccgtttggggagcaggccaaggggaatccccccgggaagaaagggaaaggtggaaacccggggggcggcccccgtcctttttttggggggaaattccccggggcagttttaaaaaacccactcaggattcttttccggttgggggggagaccnccacccaaacacaaaaaaccttntattatgggggaaaaaacctccccaccggggggcccaaaaaaacccnnggggaaacccgccccgcccctcnntccgggttttctacaacgccgctttaaagaaaaaataccccttctttttgggggaagaaagccgcgggggagaaaacaaattcccccgcggtgtgggggccacaaataaaaaaaactcttcagca

SEQ ID NO: 40831 - DNA, 735 bp, Zea mays
  misc_feature: Ceres CLONE 1434519-F
  misc_feature: Encodes the peptide sequence at SEQ ID NO. 40832
ggagctccccgcggtggcggccgctctagaactagtggatcccccgggctgcaggaattcgcacgagaccattacctagaacatcctaatcgaaaaccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaggggtctgctcgacctgacctgtcagactgttgctgacatgatcaagggcaagaccccgtaagagattcccaagaacttcaacatccagaatgacttcacccctgaggaggaagaggagaccgcagggagaacccaggggccttccgagtaggaggg

SEQ ID NO: 40832 - protein, 146 aa, Zea mays
  misc_feature: Ceres CLONE 1434519-F
  misc_feature (8)..(68): Pfam Name: Skp1_POZ Pfam Description: Skp1 family, tetramerisation domain
  misc_feature (99)..(147): Pfam Name: Skp1 Pfam Description: Skp1 family, dimerisation domain
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIRGLLDLTCQTVADMIKGKTP

SEQ ID NO: 40833 - DNA, 745 bp, Zea mays
  misc_feature: Ceres CLONE 1434524-F
  misc_feature: Translation starting site: 245
  misc_feature: SWISSPROT Homolog: EC 5.3.99.6 Allene-oxide cyclase
aaagctggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggaccgcgcgccgacaaggtgcaggacctgtacgtgtacgagatcaacgagcgggacggcaagagccccgggtacctgcgcctcagcgccaagcagacggaaaaacccctgggcgattcttgtccctttcacccaacaaggttaacaacggcagccttgaacaaacggcttggcgtccccgcggggatttggggttgccattcaaaaagttcccccaaccccaaaggggaacccttaaaagggccattaaaggttttcttatttaaaaaaaacggcccccttctggggtggggggcccttcccccaacctaaaagaaatttcccc

SEQ ID NO: 40834 - DNA, 716 bp, Zea mays
  misc_feature: Ceres CLONE 1434527-F
  misc_feature: Encodes the peptide sequence at SEQ ID NO. 40835
  misc_feature (370)..(370): n is a, c, t, g, unknown, or other
  misc_feature (423)..(423): n is a, c, t, g, unknown, or other
aaagctggagctccccgcggtggcggccgctctagaactagtggatcccccgggctgcaggaattcgcacgagaccattacctagaacatcctaatcgaaaactctcctttaaagcggactgctctcctcaattgtcagtcagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaagcgacacgctggtgntcgtccacgcccgccgcccgcgcccggtctaacgcgccatggacagcgcaggntacatgatgacctcggacgtgctggcgagcgtcaaaaggaacccacccggcctccggcgggggggtcaaaaagccaagggggttgcccggacaccggcattaaaggggaaaacaattgggaaaagggggaacccgggaagttttttgaaaccccccaaaaaaaggcccaaaccctcccctaagaacccctggttccgctttcccccaaggggttttggcgccgtaaaaaaccctccccaaaaaaataaaagcccgggccctttttaaaaaacccccaaaaaaaaagccccccc

SEQ ID NO: 40835 - protein, 56 aa, Zea mays
  misc_feature: Ceres CLONE 1434527-F
  misc_feature (47)..(47): Xaa is any aa, unknown, or other
METAAVAAAGAGRRIMVAVDEGEESLHALNWCLANVVSPAGSDTLVXVHARRPRPV

SEQ ID NO: 40836 - DNA, 643 bp, Zea mays
  misc_feature: Ceres CLONE 1434529-F
  misc_feature: Encodes the peptide sequence at SEQ ID NO. 40837
  misc_feature (260)..(260): n is a, c, t, g, unknown, or other
aaactggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctgacgccgacattttgccctcatgctcacaagctnctataggctccccttcgtccccatacctttccatcattatagcttcagtatgggaaaaccagctctttcacctatagggcttcagcagcaaacgcagcgagccacctacctttaacggccttggttgtttcaacaatcgccagccctttctttggggattgctttgtcccaaacacttgggggcaaagggttgggggaaaatctgggtaaccccttgaaaaaaacaaaaggcctgggaaaaaattttttcccctatattcctaaaaaaaaaaattttttttttctttttaaaacaaatttttttcaaccagaaaacccggtgggtttttttttttgggagcccccccatttattttctcttttttggccggggtggtggttgg

SEQ ID NO: 40837 - protein, 55 aa, Zea mays
  misc_feature: Ceres CLONE 1434529-F
  misc_feature (31)..(31): Xaa is any aa, unknown, or other
MATKIFSLLMLLALSTCVADADILPSCSQAXIGSPSSPYLSIIIASVWENQLFHL

SEQ ID NO: 40838 - DNA, 602 bp, Zea mays
  misc_feature: Ceres CLONE 1434534-F
  misc_feature (386)..(386): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
agctccccgcggtggcggccgctctagaactagtggatcccccgggctgcaggaattcgcacgagaccattacctagaacatcctaatcgaaaagtctccaacccgactctgaaatccacgagctcttccccctcgtccacaccccgcccctccctgctctccgcctccccgtccccgcccccatcgctacccacaagcaccttcggaggctccaggcaacccacctcctgcacccggcgtccctcgcggcggcgacgcgcgaacgtcccgctccccggtgagtaacggagagacggagccatgagcggaggggtggagccggataccccgcccggtagcagcagcagcagcagcagggagcgggggcagcacgcccgtgggcggnaagtcgccacgccaccacctcacgtccatcggccactggcggcagcagtgcccgcatcgccgctgcctccgccgaattctaagcaagcttnnnccttgcacccagccatcttccctacacgatttgatgccggcccttttgttctctggaggggctggattccgggaccctagcttgatttcccttaccgaaaacatccgcccggttttcttgccg

SEQ ID NO: 40839 - DNA, 712 bp, Zea mays
  misc_feature: Ceres CLONE 1434542-F
  misc_feature: Encodes the peptide sequence at SEQ ID NO. 40840
aagctggagctccccgcggtggcggccgctctagaactagtggatcccccgggctgcaggaattcgcacgagaccattacctagaacatcctaatcgagaaaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcacccagatctgtgatggcatcctcaagcttctcgaatctcaccttgtgccgtcttccaccgctcccgagtccaggtccttcttcccaggatgaagggtgaccactacaaattcctttgctgatttcaaaatggaacttaagaaaaggaccctgctaaaaaacccctgggggagaaaaaggggtccccaaaaaatttgttttggggaagatttccccaccaccccccaatagggggg

SEQ ID NO: 40840 - protein, 129 aa, Zea mays
  misc_feature: Ceres CLONE 1434542-F
  misc_feature (8)..(129): Pfam Name: 14-3-3 Pfam Description: 14-3-3 protein
MASAELSREENVYMAKLAEQAERYEEMVEFMEKVAKTVDSEELTVEERNLLSVAYKNVIGARRASWRIISSIEQKEEGRGNEDRVTLIKDYRGKIETELTQICDGILKLLESHLVPSSTAPESRSFFPG

SEQ ID NO: 40841 - DNA, 707 bp, Zea mays
  misc_feature: Ceres CLONE 1434543-F
  misc_feature: Encodes the peptide sequence at SEQ ID NO. 40842
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (546)..(546): n is a, c, t, g, unknown, or other
  misc_feature (611)..(611): n is a, c, t, g, unknown, or other
ggagctccccgcggtggcggccgctctagaatagtggatcccccgggctgcaggaattcgcacgagaccattacctagaacatcctaatcgaaaaaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcagagcctggcgtcgtacggcgggtcgccgccgccgcggagcccgcgggagctggcgcgcgccgcgctgtcggtgagcgcggaccgcgcgcgcgccgcgtcagcgtacgtgggccgcctgtgcagcgccagcaccgcaaaagctcgaaaaagggtcggaatcggcctctgcgggnnnnnnncngcagggtccgtgcgcgactgcctggacaatctggcggacagcgtgggcccacctccgcgactcgncgcaggaacatggcccgccccccggatgagccacatcggggacccccggctttcaggtggcacctcagcaaactggaagacctgggtgcagcgccc

SEQ ID NO: 40842 - protein, 167 aa, Zea mays
  misc_feature: Ceres CLONE 1434543-F
  misc_feature (112)..(112): Xaa is any aa, unknown, or other
  misc_feature (113)..(113): Xaa is any aa, unknown, or other
  misc_feature (114)..(114): Xaa is any aa, unknown, or other
  misc_feature (136)..(136): Xaa is any aa, unknown, or other
MAHPRSVAAAAPLLLLLAAAAAAAAGLVSAASPAASDFVRKSCRTTQYPSVCEQSLASYGGSPPPRSPRELARAALSVSADRARAASAYVGRLCSASTAKARKRVGIGLCGXXXAGSVRDCLDNLADSVGPPPRLXAGTWPAPRMSHIGDPRLSGGTSANWKTWVQR

SEQ ID NO: 40843 - DNA, 568 bp, Zea mays
  misc_feature: Ceres CLONE 1434553-F
  misc_feature: Encodes the peptide sequence at SEQ ID NO. 40844
  misc_feature (369)..(369): n is a, c, t, g, unknown, or other
  misc_feature (370)..(370): n is a, c, t, g, unknown, or other
  misc_feature (419)..(419): n is a, c, t, g, unknown, or other
  misc_feature (420)..(420): n is a, c, t, g, unknown, or other
  misc_feature (529)..(529): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcgaaaaaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcagggactaccanngtggacctgtcccactgcgggccgatgggtgctggaaccccctgctccnnaatcaaaaaacgaaggggggacccgggtgcttacactttttcccgccccaaattttggccggggggggggggacccctcgggggggggagacccccccccccccccttnnaaaaaaattttgggggggggaaaaaacgccctcccctc

SEQ ID NO: 40844 - protein, 135 aa, Zea mays
  misc_feature: Ceres CLONE 1434553-F
  misc_feature: SWISSPROT Homolog: EC 1.3.5.1 Succinate dehydrogenase (ubiquinone)
  misc_feature (69)..(69): Xaa is any aa, unknown, or other
  misc_feature (70)..(70): Xaa is any aa, unknown, or other
  misc_feature (86)..(86): Xaa is any aa, unknown, or other
  misc_feature (123)..(123): Xaa is any aa, unknown, or other
MAAALLRRSPAARALLSPALSSRLVASKPHSSSPAPPPPAKADSSTKTFSIYRWDPDSPSTKPHLRDYXXGPVPLRADGCWNPLLXNQKTKGGPGCLHFFPPQILAGGGGTPRGGETPPPPLXKKFWGGEKTPSP

SEQ ID NO: 40845 - DNA, 635 bp, Zea mays
  misc_feature: Ceres CLONE 1434556-F
  misc_feature: Encodes the peptide sequence at SEQ ID NO. 40846
  misc_feature (1)..(1): n is a, c, t, g, unknown, or other
  misc_feature (257)..(257): n is a, c, t, g, unknown, or other
  misc_feature (374)..(374): n is a, c, t, g, unknown, or other
  misc_feature (375)..(375): n is a, c, t, g, unknown, or other
  misc_feature (377)..(377): n is a, c, t, g, unknown, or other
  misc_feature (378)..(378): n is a, c, t, g, unknown, or other
  misc_feature (383)..(383): n is a, c, t, g, unknown, or other
  misc_feature (385)..(385): n is a, c, t, g, unknown, or other
  misc_feature (386)..(386): n is a, c, t, g, unknown, or other
naaagctggagctccccgcggtggcggccgctctagaactagtggatcccccgggctgcaggaattcgcacgagaccattacctagaacatcctaatcgaaaaatctcccataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacnttgctcctagtgccagtattccacagttcctcccccagttacttcatgggcttcgacatccagccgtgcaagctacaggctacaactagcgcttgcggcgagcgcctttacacaccnnanntgccnanntgcacaacaatccttggcacatctaaccctacaaacccattgcaacggcaacaacaacaacaacagttttctggccatccctagagcccccctaacccgggggggaaaccccctggtcaccctaattggaaacaagaactgtgttgggatccaacccccttttttctttgggaaaaattatttgttttccaaaaaaaaaaaaacagtgggaaaaaaattttttgcccgggggcccaacaaaaaatagcg

SEQ ID NO: 40846 - protein, 31 aa, Zea mays
  misc_feature: Ceres CLONE 1434556-F
  misc_feature (29)..(29): Xaa is any aa, unknown, or other
MATKILALLALLALLVSATNAFIIPQCSXCS

SEQ ID NO: 40847 - DNA, 658 bp, Zea mays
  misc_feature: Ceres CLONE 1434558-F
  misc_feature: Encodes the peptide sequence at SEQ ID NO. 40848
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaaaaaaaataaccagacaatgagcttaacgcttctccagggctactcctccgctgaggacgacgacgatcccgccgccggcgccggcgctggcaccgagctgagcgagtctggtgattcgtcagccgaggaagccggatcggacgaagacgaggagtccgctcctccaaagccgccccccaagctccgccgccgaccaaaccctaaggggggagatgccggcggcagcgacgggggctccttgctgccctccgcgctggaggccttcgctgatgtctcgggaccaccagattttttgaggcacagggttgccgagccagaggaagggacggaggccctcggtgtctcgaatcgcccgtgggaaagaggggagcaaacagccgcctccaggtgctgttgtggtgggcaaaccacagatagttgctatccgcgagcgagttaccacactggagcccaccccccagggtcagtgacagctgggtctattggatggaaaagaagaaaaagtggctgcaatccctggggcaaaaaacccgctggtcttctaaagggggggc

SEQ ID NO: 40848 - protein, 179 aa, Zea mays
  misc_feature: Ceres CLONE 1434558-F
MSLTLLQGYSSAEDDDDPAAGAGAGTELSESGDSSAEEAGSDEDEESAPPKPPPKLRRRPNPKGGDAGGSDGGSLLPSALEAFADVSGPPDFLRHRVAEPEEGTEALGVSNRPWERGEQTAASRCCCGGQTTDSCYPRASYHTGAHPPGSVTAGSIGWKRRKSGCNPWGKKPAGLLKGG

SEQ ID NO: 40849 - DNA, 668 bp, Zea mays
  misc_feature: Ceres CLONE 1434571-F
  misc_feature: Encodes the peptide sequence at SEQ ID NO. 40850
aaagctggagctccccgcggtggcggccgctctagaactagtggatcccccgggctgcaggaattcgcacgagaccattacctagaacatcctaatcgaaaaacttgaggagtttgggggggagcttctgctctctgtgcagttgcttggcgcggacagagagcattgcctgcacagagcagaactactggtccagatcatggaaggcgaacaggtgtacgtggactggagagggaatgcggcggacgagaggaggcacggaggcgtcagggcaacgatcttcctctacgttctgttcatgctacgaagctgctgtaacagctcaaacttcaccgtggtggcctatttgcacggcacgttgcatctggacattgtgacctcatcaaccgtgataggctacctggttggcaccgtgatgatatctgctgctctgatgaacttcatctctgatgcgtcgtgtatcaagcgagccaccgctatatttgtattcggaccctgcgtgatcctgggttacatgttgctagcactgcaagcccatttccctgcactccatcctgaaacctgtgccatagacgaagagccaaacaactgtgaggcagctcggggttggaagttgacactgctctgcttgggcctgttcatgtttgctgttggggagggctgcatgc

SEQ ID NO: 40850 - protein, 156 aa, Zea mays
  misc_feature: Ceres CLONE 1434571-F
MEGEQVYVDWRGNAADERRHGGVRATIFLYVLFMLRSCCNSSNFTVVAYLHGTLHLDIVTSSTVIGYLVGTVMISAALMNFISDASCIKRATAIFVFGPCVILGYMLLALQAHFPALHPETCAIDEEPNNCEAARGWKLTLLCLGLFMFAVGEGCM

SEQ ID NO: 40851 - DNA, 679 bp, Zea mays
  misc_feature: Ceres CLONE 1434577-F
aaactggagctccccgcggtggcggccgctctagaactagtggatcccccgggctgcaggaattcgcacgagaccattacctagaacatcctaatcgaaaaatccaccatattatgtgataccaacagcaacatagaaagtggaatcccgtatcaacaatagagcaacaatggccaccaacatattttaccctccttatgctccttgctctttctgcgtgggttgataacgcgacaattttccctcaatgctcacaagctcctatagcttcccttcttcccccataccttccatcgatgatagcttcagtatgtgaaaacccacctcttcaaccctataggctccaacaagcaatcgcagcaagcaacatacctttatacacccttggttcaacaatcgccacccctatctttggagcagtcattggtacaaaccatcagggcacagcagctgcagcaactcgtgctacctgtgatcaaccaagtagctctggcgaacctttctccctactctcagcaacaacaatttcttccattcaacctactggctacattgaaccgtgctgcttatttgcagcaacaactattaacattcatccggctagctactgcctactctcagcaacaacaacttcttccatttaaccaattggccgcactgaaccccgctgcttatttgc

SEQ ID NO: 40852 - DNA, 667 bp, Zea mays
  misc_feature: Ceres CLONE 1434579-F
  misc_feature: Encodes the peptide sequence at SEQ ID NO. 40853
aaagctggagctccccgcggtggcggccgctctagaactagtggatcccccgggctgcaggaattcgcacgagaccattacctagaacatcctaatcgaaaaagcagatcttgtgaccctccctcagccgcgtcgcgtcgcatcctacgatccaaagctctctctgctcgcaggtcgcagccatggggaagaactacccgaccgtgagcgccgagtacagcgaggctgtggacaaggacaggcgcaggctccaagccctcatcgccgagaagagctgcgccccgctcatgctccgcctcgcgtggcactccgcggggacgttcgacgtgacgtcgaggaccggcggtccattcgggacgatgaagcatctctcggaattggctcacggcgctaacgcggggctggacacctcggtgcggctgctcaagcccatcaaggaggagttcccaatcctctcttacgccgatttctaccaactcgcgggagttgtggccgtggaggtcaccggagggccggacattcccttccaccccggtagggaggacaagcctcagcccccacctgagggccgccttcctgatgccactaagggttctgaccacctgagggaagtttttggcaagcagatgggcttgagcgatcatgacattgttgccctctctggtgg

SEQ ID NO: 40853 - protein, 161 aa, Zea mays
  misc_feature: Ceres CLONE 1434579-F
  misc_feature (19)..(161): Pfam Name: peroxidase Pfam Description: Peroxidase
  misc_feature: SWISSPROT Homolog: EC 1.11.1.11 L-ascorbate peroxidase
MGKNYPTVSAEYSEAVDKDRRRLQALIAEKSCAPLMLRLAWHSAGTFDVTSRTGGPFGTMKHLSELAHGANAGLDTSVRLLKPIKEEFPILSYADFYQLAGVVAVEVTGGPDIPFHPGREDKPQPPPEGRLPDATKGSDHLREVFGKQMGLSDHDIVALSG

SEQ ID NO: 40854 - DNA, 744 bp, Zea mays
  misc_feature: Ceres CLONE 1434580-F
aaagctggagctccccgcggtggcggccgctctagaactagtggatcccccgggctgcaggaattcgcacgagaccattacctagaacatcctaatcgaaaaatttttccccgctctgctctgcacgtcgctctcttccctagtccctcccccgacccccgcccgtcaaagcgagagcgccgtatctcctgtctctccgtccacggccgtctctatccgcgcccaaagatacctttcccccaccccttcctcgcgccggcgttttggtgccaccatgacagcagagggggaggccaagaacccgtcggccgggggcggaggggataaccaccagcaccagcagggtgcgcctgtgccgggtcttttatagggggaaggggcgcaagaggctgcagtgtaggagatggtgaaagacccccccccgggacactgcgcatcaaagaaggagagggcgctcgcgggcgaagaaggaccgacggggccggggacctagatctgggtccctgggccgaggtatccggaaggggcccccccccatccggggatccgggaagaaggcttgaggcctgaaaggccgcaacccgcgtagaaaaaaagtgaaaaccgggttgggggaatgcccctcccttgaaaggggggcgtgggagctaatattttcctatggaaatatctctgcgttcccggggaggaaagaacgacgcggctgcctgtgtgtggtccgccctgtcgtctgggggggacgcg

SEQ ID NO: 40855 - DNA, 661 bp, Zea mays
  misc_feature: Ceres CLONE 1434583-F
  misc_feature: Encodes the peptide sequence at SEQ ID NO. 40856
tccccgcggtggcggccgctctagtacagaagagatgccccgggctgcaggaattcccacgagaccattacctagaacatcctaatcgaaaagcgaatgactcctatcctttctttgtttatctccgcctggctcctccacaccaaaccctgtccgccgcccactgactactgcgctgcttgttgcaaggttgtctctcccgcctccactcctgcatccagcggcatccctaccacaaaaactgccaccgcccgcttcacgacggcgccgagacgactccgaaccagcggaggaagccgtgcctcccccactcaagctcgcagagcatctcgttcccgatccggaggtcgtggaccgagtgcaacatcatgtctatgaacttgcccgcggcttcttcctcgtcttcttcgaatctggagtcgctttcttcgtcttcttctctcacgactttggccgacttgccggcggagacggcagcagtggtggatccgacgaaacctcgtcagctgggatggaccattgatgaatgcccaacatgcccgatcgatattgagtgctgatgacgatcattttccgcgaccaaggttgatgactgctaatctccgagatgcaactaattttcgccataacatgatctatgcagcttcttccataaacatat

SEQ ID NO: 40856 - protein, 63 aa, Zea mays
  misc_feature: Ceres CLONE 1434583-F
MSMNLPAASSSSSSNLESLSSSSSLTTLADLPAETAAVVDPTKPRQLGWTIDECPTCPIDIEC

SEQ ID NO: 40857 - DNA, 685 bp, Zea mays
  misc_feature: Ceres CLONE 1434596-F
  misc_feature: Encodes the peptide sequence at SEQ ID NO. 40858
  misc_feature (663)..(663): n is a, c, t, g, unknown, or other
  misc_feature (664)..(664): n is a, c, t, g, unknown, or other
  misc_feature (671)..(671): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaaacctagaacatcttaatcgaaaattatattcttctgcctgcccttccgttcaatttcaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaatatgctggtttttgtgacgccccatcaatttgtggagggtatatgtaagaagcttgtagggaagctaacaccaggagctgaggctatctccctcatcannggcatgnaggtcaagatngaa

SEQ ID NO: 40858 - protein, 134 aa, Zea mays
  misc_feature: Ceres CLONE 1434596-F
  misc_feature (10)..(132): Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
  misc_feature (127)..(127): Xaa is any aa, unknown, or other
  misc_feature (130)..(130): Xaa is any aa, unknown, or other
  misc_feature (133)..(133): Xaa is any aa, unknown, or other
MEMENGHAKYRVAVIGSGNWGSVASRLIASNTAKLPSFYDEVRMWVFEEILPTGRKLSESINEQNENCKYLPGIKLGTNVIADPDLESAVKDANMLVFVTPHQFVEGICKKLVGKLTPGAEAISLIXGMXVKXE

SEQ ID NO: 40859 - DNA, 656 bp, Zea mays
  misc_feature: Ceres CLONE 1434598-F
  misc_feature: Encodes the peptide sequence at SEQ ID NO. 40860
  misc_feature (399)..(399): n is a, c, t, g, unknown, or other
  misc_feature (656)..(656): n is a, c, t, g, unknown, or other
aagctggagctccccgcggtggcggccgctctattctagtggatcccccgggctgcaggaattcccacgagaccattacctagaacatcctaatcgaaaagcagcgcaaaaccctagcctcgcccgtcccaaaccctggcggctacggtctctgatcccggtccaatggcgtcgtcgccggacttgttccctaacgttgccttctccgacgtctctgccgccgcccccgcggccgaggccaccgccgcgttcgggctcggcgccgccaccggggccccgcgcctctgcctcgtcaagtccgggaaggacgaggcggagcccactgtcgacatcgacctcgccgatgcgcaggtatttaagttgggaccgatggagtggctgtgcgtgtgcgacgagtcngaggctaaggctggcgtggaagaagagtcatttttcagagcaattaaaggtgttcttaggacagaagctgaagagcaagccttctccttagcttttcaacatggaaacctcaagttattagtgggaaagctggtgagaggttgggagatggatcaataattgctttcaaaaagcaatttgatacaaaaatttgagcatcatcagcaaagatggttttccccttctaccgggcaattatttcctccgcaaaaactggn

SEQ ID NO: 40860 - protein, 130 aa, Zea mays
  misc_feature: Ceres CLONE 1434598-F
MASSPDLFPNVAFSDVSAAAPAAEATAAFGLGAATGAPRLCLVKSGKDEAEPTVDIDLADAQVFKLGPMEWLCVCDESEAKAGVEEESFFRAIKGVLRTEAEEQAFSLAFQHGNLKLLVGKLVRGWEMDQ

SEQ ID NO: 40861 - DNA, 669 bp, Zea mays
  misc_feature: Ceres CLONE 1434601-F
  misc_feature: Encodes the peptide sequence at SEQ ID NO. 40862
aaagctggagctccccgcggtggcggccgctctagaactagtggatcccccgggctgcaggaattcgcacgagaccattacctagaacatcctaatcgaaaaaggtcttccactcttcctccactagtctactcggcagatttcactgactctcaccggcggtttttgtgcctccaccggccgccgccatgccgtacctcgtccgcgagcggctctactttggcggcatcaaagacgccattgccgcactcacggagtcttcctccacgccggacttcacccacgtcctctccgtggtcagctccgcctccatctccttcatcaccgattgccgcccggggctcgagatccccacccgagaggtcctccgcgtagtcgccggcgaggaggggcgcggcaccgactgccgcgggtccccccgggaaccctgatccggggtggtggaacccccccggcaacgggctgccggtccacccaatggcccttccccttccggaaaaccaagaagaaggacctggtctaaccccctgagccctgccttgggtcccccaaaaaggcgaggaaagggcggaaatcccccccccacttctttttgggggggggccagaaagccctccccacattgggcttttcttagagaggccaaaaaaaaattctttgaaaaaattt

SEQ ID NO: 40862 - protein, 80 aa, Zea mays
  misc_feature: Ceres CLONE 1434601-F
MPYLVRERLYFGGIKDAIAALTESSSTPDFTHVLSVVSSASISFITDCRPGLEIPTREVLRVVAGEEGRGTDCRGSPREP

SEQ ID NO: 40863 - DNA, 651 bp, Zea mays
  misc_feature: Ceres CLONE 1434602-F
  misc_feature: Encodes the peptide sequence at SEQ ID NO. 40864
ggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgc

SEQ ID NO: 40864 - protein, 108 aa, Zea mays; identical to SEQ ID NO: 16131
  misc_feature: Ceres CLONE 1434602-F

SEQ ID NO: 40865 - DNA, 764 bp, Zea mays
  misc_feature: Ceres CLONE 1434608-F
  misc_feature: Encodes the peptide sequence at SEQ ID NO. 40866
  misc_feature (79)..(79): n is a, c, t, g, unknown, or other
  misc_feature (81)..(81): n is a, c, t, g, unknown, or other
  misc_feature (82)..(82): n is a, c, t, g, unknown, or other
  misc_feature (764)..(764): n is a, c, t, g, unknown, or other
ttttccccgctcttttatgtcgccccgctgctcgcgcggtgccgcgcgcgccgcgggggcggggggggggccccttttntnntttaaactggagctccccgcggtggcggccgctctagactagtggatcccccgggctgcaggaattcgcacgagaccattacctagaacatcctaatcgaaaaatgatcacacacggctcctcagcagttgcaagagggatagagcaaggccacacacacacacacaccactagtagggtagcctagccttttactcgtcgaggaggagcaagaagggcgcgcacgccagcaggcaagcaagaagagagccgatcgaccgagagctagcacgcgatggcgaggtcttccaagatgatggtggcggcagctctgctgggcttggccctggccgtgtcgaccgccgaggcgaggaacatcaagaccaccactactgacaagaaggacgacgcggtggtgcagccgcagagcttcccgcccttcgaccgcctcggcggcggcgcgtccccggcgttcggcggcctccccggtggccgaattcctggcaacagcctttcccgggttccagcatgcccgggcagcggtacgtagcctacccggggttccagctttgccccgggcagccgggcagcattgcccccttcttccaggcggtcggactccccccggggcattcacgccgggcctccggccgggacatgcccccgggggttcgcacaccacccgttccatggtttttccgtn

SEQ ID NO: 40866 - protein, 84 aa, Zea mays
  misc_feature: Ceres CLONE 1434608-F
MARSSKMMVAAALLGLALAVSTAEARNIKTTTTDKKDDAVVQPQSFPPFDRLGGGASPAFGGLPGGRIPGNSLSRVPACPGSGT

SEQ ID NO: 40867 - DNA, 655 bp, Zea mays
  misc_feature: Ceres CLONE 1434610-F
  misc_feature: Translation starting site: 137
ctggagctccccgcggtggcggccgctctagaactagtggatcccccgggctgcaggaattcgcacgagaccattacctagaacatcctaatcgaaaaaatcccagatccacccctccccatctccatccgcggccatggcctccgccgacgccggcacttgcccgtgggatgccctcccgttgcacctccaggagcgaatcctctccctcctccccatcaccgaactacttcccgttgccgccgtgtcccgcgccttccaccgccttctgcgctccccgaccttccatgccctcctctccccgcatcgcctcgacgccttcttcctcctttccccacggctcgccgtccacccgctgtcccgccgcgtccgcactatgcccgcgttcgccgcgctctctcctctttctagccgctcgtctcctccccgtccccatcactccttatcaactgcgccttcactccagtttcttccggccgatccccgacggagcctacctcctatccgctatcgtccaatcggggggctcctccacctcctggaactttggtcgccgttttcccggggaaacccccggtttttaccactgggaaccggggataccctcccccgaggggggtttaagagaggaatccccgtgttttcccaccccccg

SEQ ID NO: 40868 - DNA, 735 bp, Zea mays
  misc_feature: Ceres CLONE 1434611-F
  misc_feature: Encodes the peptide sequence at SEQ ID NO. 40869
  misc_feature (78)..(78): n is a, c, t, g, unknown, or other
  misc_feature (79)..(79): n is a, c, t, g, unknown, or other
  misc_feature (81)..(81): n is a, c, t, g, unknown, or other
  misc_feature (735)..(735): n is a, c, t, g, unknown, or other
ggttggggcgcggcgcgcggggcggccgcataccccctcccttttgtcgtcgccgccccatttttggccccggggggnngngcagagctggactccccgcggtggcggccgctctttactagtggatcccccgggctgcaggaattcgcacgagaccattacctagaacaccctaatcgaaaaaccgcatcccacaacccttgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggtgggtctgatcgcggcggcggtggcgcacgcgttcgcgctgttcgtgacggtgtctgggggcgcgaacatctccgggaggcacgtgaaaccctgccgagaccttcggcgccttcctgggggggaacatcacccctggtccggggggctcctgtactggggggccgcaactgcctgggggccaaccgggggggtgcctcccggcccccgcttctcgacgggggggggagggccacggtcacccctccgggctgaacggggcccggtccggtgttcggaaggtccctgctgcn

SEQ ID NO: 40869 - protein, 152 aa, Zea mays
  misc_feature: Ceres CLONE 1434611-F
MPINRIALGSHQEVYHPGALKAAFAEFISTLIFVFAGQGSGMAFSKLTGGGPTTPVGLIAAAVAHAFALFVTVSGGANISGRHVKPCRDLRRLPGGEHHPWSGGLLYWGAATAWGPTGGVPPGPRFSTGGGGPRSPLRAERGPVRCSEGPCC

SEQ ID NO: 40870 - DNA, 711 bp, Zea mays
  misc_feature: Ceres CLONE 1434616-F
  misc_feature: Encodes the peptide sequence at SEQ ID NO. 40871
ggagctccccgcggtggcggccgctctataactagtggatcccccgggctgcaggaattcgcacgagaccattacctagaacatcctaatcgaaaaaaaaaatctaaactgataataatatggccactaaaatcttctctccaactccccccgtcatctcctcaacctcagccaccaccaaaacgccggtcctccccaaggcattagtatcgcgatgtctacgcacctctctttctgccgttgtcgccgcgactgccgtcctgacgatggttccggcgttgcctgccgcgggtgaggggaaccaaccctacaaattatactacgggacagcagctagcgcggcgaactacgggggatacggagggaactcggacaggaagacatcggcggagtatgtgtacgacgtgccggacgggtggaaggagaggctggtgtcaaaggtggagaagggcacaaacgggacagacagcgaaatttaccaccccaagaagaagacagaggaggagtacccttacgttcttggtcggggttcaaacagctggcccccaagggatgtgatccttaaacaacctggccttggtcaaacgtgggagccccgggatttggaaaaggagggccctaaataaaaggggttgccttgggggaaaaaaaggggttaaagagcccggggcgagggggtttcctatttgtttccgaaaatacgaggggaaa

SEQ ID NO: 40871 - protein, 119 aa, Zea mays
  misc_feature: Ceres CLONE 1434616-F
MVPALPAAGEGNQPYKLYYGTAASAANYGGYGGNSDRKTSAEYVYDVPDGWKERLVSKVEKGTNGTDSEIYHPKKKTEEEYPYVLGRGSNSWPPRDVILKQPGLGQTWEPRDLEKEGPK

SEQ ID NO: 40872 - DNA, 680 bp, Zea mays
  misc_feature: Ceres CLONE 1434627-F
  misc_feature: Encodes the peptide sequence at SEQ ID NO. 40873
  misc_feature (656)..(656): n is a, c, t, g, unknown, or other
  misc_feature (657)..(657): n is a, c, t, g, unknown, or other
  misc_feature (680)..(680): n is a, c, t, g, unknown, or other
aagctggagctccccgcggtggcggccgctctagaactagtggatcccccgggctgcaggaattcgcacgagaccattacctagaacatcctaatcgaaaacttcgctgcgccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggttgatattgttgacacattccgtctacaggagcaacctccttttgacaagaaatcatttgtctcttacataaaaaaatacatcaagaatctcactgctgtgttggagccagagaaagcggatgagttcaaaaagggtgtcgagggtgcaccaaagtttctcctttagcagctgaaggacctttcatttttttgtggtgagagcatgaaggacgaagccgtcggtggtattcgccctatacaaggatggtgccacctatccgacattccctctattctctcatggnnctaaggagatcagtgctagatan

SEQ ID NO: 40873 - protein, 121 aa, Zea mays
  misc_feature: Ceres CLONE 1434627-F
  misc_feature (1)..(122): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGAPKFLL

SEQ ID NO: 40874 - DNA, 635 bp, Zea mays
  misc_feature: Ceres CLONE 1434636-F
  misc_feature: Encodes the peptide sequence at SEQ ID NO. 40875
  misc_feature (399)..(399): n is a, c, t, g, unknown, or other
  misc_feature (505)..(505): n is a, c, t, g, unknown, or other
aagctggagctccccgcggtggcggccgctctagaactagtggatcccccgggctgcaggaattcgcacgagaccattacctagaacatcctaatcgaaaaacagtgcctctcgctcactgactgactgtaataccagagatcgaacaacttggtcctgcagctcaagaagagagtttttgtgcatttgggggccgggggcaagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaaacacgcgcttcacctgcaccgccatcacggaggggcganctaaacaagatttgagccactggggacctcccctagcaaaggcgaaaaaatggggccaaaaaaaaaattgggtcccttccttcttaccccaaaagggaccccccangttacccccacagggggggtttagagggggaaaccccgggggccccccaggggggcgggtttacctgggaaggggcggcccgggcgaaagaaaaaaaggggggggtccccaccccccccgcggggagggg

SEQ ID NO: 40875 - protein, 59 aa, Zea mays
  misc_feature: Ceres CLONE 1434636-F
MAADQQPQLQEEMNDAAGGGLRLPPGFRFHPSDFEIVSFYLTNKVLKHALHLHRHHGGA

SEQ ID NO: 40876 - DNA, 669 bp, Zea mays
  misc_feature: Ceres CLONE 1434647-F
  misc_feature: Encodes the peptide sequence at SEQ ID NO. 40877
agagctggagctccccgcggtggcggccgctctagaactagtggatcccccgggctgcaggaattcgcacgagaccattacctagaacatcctaatcgaaaaaaagacgtcccttcccgaccgtcccttctatcccgggggtggcggctcgggaccatgaccatcctgtatactacggagatggatgcgggtcggggtcttggtaccctcaacggcatccacaatactggcacagcgggtggtccacctctttccgatgctgctgcagcgggatcttaatgatgttctccttcttggcggtcctagttctggccgtcgcgcttcgtcgtcgtggattggttgatcccctcctaactccattggaccacatccaggtgtgctcgcagtacctcctggtgcccatcgccgagaagtcactcgacagcgtgccccccggtgcctcctacgtctacctcaacatcacgctgctcttcacctccgataagctcaacaaggtgtggatcctgtactgcgccgctgtgttcaacgtcgtgctacacgggatgcctgctcggtgtggctgacggtaacccgttttcaaatacccctaagcagaagtacgccctcttgcttcgggaccccgggaaattggtcgacctggcttaaaaggggtttccaaaaccgacatcc

SEQ ID NO: 40877 - protein, 94 aa, Zea mays
  misc_feature: Ceres CLONE 1434647-F
MMFSFLAVLVLAVALRRRGLVDPLLTPLDHIQVCSQYLLVPIAEKSLDSVPPGASYVYLNITLLFTSDKLNKVWILYCAAVFNVVLHGMPARCG

SEQ ID NO: 40878 - DNA, 597 bp, Zea mays
  misc_feature: Ceres CLONE 1434650-F
  misc_feature: Encodes the peptide sequence at SEQ ID NO. 40879
aaagctggagctccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctccgttcgtcagatgggcgggccatgccgcccagccgtgctgcgcggcatcgcagcctgctgcacaggcaacacaccccgaccgcccacatctgcggctgctcaagacgtcgccacggcgccacgggagcggacctcattaaccgcgccgcccccctgcccagaaagggcggggtccccctgcccaacaagaaccgccccaacgttaacctgccccccattaatttaagtgatgaaggctccctgtggccccc

SEQ ID NO: 40879 - protein, 126 aa, Zea mays
  misc_feature: Ceres CLONE 1434650-F
MAAPKLATLALAVLLAATVVAPPAAVRAAMSCSTVYSTLMPCLRSSDGRAMPPSRAARHRSLLHRQHTPTAHICGCSRRRHGATGADLINRAAPLPRKGGVPLPNKNRPNVNLPPINLSDEGSLWP

SEQ ID NO: 40880 - DNA, 677 bp, Zea mays
  misc_feature: Ceres CLONE 1434651-F
  misc_feature: Encodes the peptide sequence at SEQ ID NO. 40881
  misc_feature (422)..(422): n is a, c, t, g, unknown, or other
  misc_feature (645)..(645): n is a, c, t, g, unknown, or other
ggagctccccgcggtggcggccgctctagaactagtggatcccccgggctgcaggaattcgcacgagaccattacctagaacatcctaatcgaaaatccactcccaaccccaccagaccttcaaccgctacatttccgtcactaccggagccgccactcccacgaacgcgggcggcggagcggaagcgaaccagttatctagtggagttgcctccttcaagctactctaatgtcctttctattcaagtctagcaatggcggcaccactgaaaaaatcccatccccagaagaacagcgagaaaaaaataaatgaattacgcaaggagcttggtgaacactcatcagaagccattaaagacttcctttcagatgcctcgttagtgcgatttcttcgagcagggactggaatgtgcagaaagctnagtaaatgatgaaagcagctgtgaagtgccggcttgcattcaaacctgaaaacatctggtggggatgatattgcagaagaagcagagactgggaaggattattggggcggattataaggaccaccttggcagaactgttcctggattggggcctggcttaaagaacccctcccccgcaaaaggggccaatcaaaattttaggcccacccccctgggaaaaacnttttttaaccctgccggaaaacccaaaaaaaa

SEQ ID NO: 40881 - protein, 58 aa, Zea mays
  misc_feature: Ceres CLONE 1434651-F
MAAPLKKSHPQKNSEKKINELRKELGEHSSEAIKDFLSDASLVRFLRAGTGMCRKLSK

SEQ ID NO: 40882 - DNA, 648 bp, Zea mays
  misc_feature: Ceres CLONE 1434655-F
  misc_feature: Encodes the peptide sequence at SEQ ID NO. 40883
aagctggagctccccgcggtggcggccgctctagaactagtggatcccccgggctgcaggaattcgcacgagaccattacatagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcgtccgggctagacgccgacggcggcaagcggagccatttctccagcatcagaagtgacgacggccagaggtcgctcgacgcagtggtaaaaacggccggcaaggaggccttccagtggggttagtggtgtgattagtctgttcagatctaacagtacgttggaggtccacaagtagtataaccctgtttctctcgacctcgacatgcagggttggcagccggagtctactcagggctcacgtacgcgctgc

SEQ ID NO: 40883 - protein, 104 aa, Zea mays; identical to SEQ ID NO: 33609
  misc_feature: Ceres CLONE 1434655-F

SEQ ID NO: 40884 - DNA, 663 bp, Zea mays
  misc_feature: Ceres CLONE 1434656-F
  misc_feature: Encodes the peptide sequence at SEQ ID NO. 40885
  misc_feature (352)..(352): n is a, c, t, g, unknown, or other
aagctggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcngtgatggtgcccatcaccatcctcaagtccgctgttagcgacggagctgtgtgcatggatggaacgccacctgcttaccacttggatcctggctcccgagcgggcagcagaagctggattgtgaacttagagggaggtgcgtggtgcaacagcgccaagacatgccggctcaccaggagctccggccgtggctcgtcggaccacatggacaaagagatccccttcaccggcatcatgagcagcagccgtaccgtgaatcctggtctcgcccgattctaatttctacatctggaaccgggtcaagttcgcta

SEQ ID NO: 40885 - protein, 146 aa, Zea mays
  misc_feature: Ceres CLONE 1434656-F
  misc_feature (41)..(147): Pfam Name: PAE Pfam Description: Pectinacetylesterase
MADRPSLPALIIAIAVLAGSYCRVASSASPAVEDELRGGGGAGGPTTMRRRAASVMVPITILKSAVSDGAVCMDGTPPAYHLDPGSRAGSRSWIVNLEGGAWCNSAKTCRLTRSSGRGSSDHMDKEIPFTGIMSSSRTVNPGLARF

SEQ ID NO: 40886 - DNA, 669 bp, Zea mays
  misc_feature: Ceres CLONE 1434663-F
aaagctggagctccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaatgcgccccgcaggcccaccttcgtgggcatctggaagaagcgtgcggtggagcagtactcgccgatcccgtacgtggcgac

SEQ ID NO: 40887 - DNA, 750 bp, Zea mays
  misc_feature: Ceres CLONE 1434664-F
  misc_feature: Translation starting site: 309
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (99)..(99): n is a, c, t, g, unknown, or other
  misc_feature (100)..(100): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (135)..(135): n is a, c, t, g, unknown, or other
  misc_feature (143)..(143): n is a, c, t, g, unknown, or other
  misc_feature (144)..(144): n is a, c, t, g, unknown, or other
  misc_feature (147)..(147): n is a, c, t, g, unknown, or other
  misc_feature (148)..(148): n is a, c, t, g, unknown, or other
  misc_feature (150)..(150): n is a, c, t, g, unknown, or other
  misc_feature (152)..(152): n is a, c, t, g, unknown, or other
  misc_feature (153)..(153): n is a, c, t, g, unknown, or other
  misc_feature (215)..(215): n is a, c, t, g, unknown, or other
  misc_feature (526)..(526): n is a, c, t, g, unknown, or other
nnnnnnnnnnnnnnnccccccnnnnnnnnnnnnnnnnnggggnnnnnnnnnannnnnnnnnnnnnnnnnaaggggnnnnttannnnnnnntaaaggaannccggggggggggnnntcaaaagcgggactccaccncggcgggnnggnngngnnggttcccacgcccgcgggggggggaggaggaatttacccaagaccaggacgggagaaatccnaatcgaacaatcaactcgcaatttcgcattcgtccaaactcgtgagcactttctcctcggccccgacaagccactcgaaggcgagagacgggcatggactccaccggcaccggagcagcggggaagggaaagaagggagcggccgggcgcaagggcggcgggccaaggaagaagtcggtgtcgagggccgtgaaggctgggctccagttccccgtcggccgcatcgggcgctacttgaagaagggccgctacgcgcagcggggcggcaccggcgcccccgtctaccgcggcgggggggggcgaagacctcnccgctgagggtctggagctcgccggtaatgctgccagggacaacaagaagactcgcattattccgcgccacgtgcttctggcgatccggaacgacgaggagctcgggaagctgctgggcggcgtgaccatcgctcacggaggggggctccccaatatcaaccctgttctgctgcccaagaagacggcggagaaggcgtccagtggcgggagcaaggaggcaaag

SEQ ID NO: 40888 - DNA, 660 bp, Zea mays
  misc_feature: Ceres CLONE 1434665-F
  misc_feature: Translation starting site: 471
aagctggagctccccgcggtggcggccgctctagtactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtggcgccgccggttcatctgccgccgccaccatgccactaccctactcaaccgccccgggctcagcctcatccccagccacacccatgcccgtggcaacagccgcatcccagcccgtgccagctgcaaggaacctgcggcgtttgcagcaacccgatcctggggcaatgcgtccagtttctgaaggatcagtgcagccggacggcgaccgcctactggctcgcctaatgccagtcgttggcgcagcagtggttgcagcagctcatgcaggtggag

SEQ ID NO: 40889 - DNA, 706 bp, Zea mays
  misc_feature: Ceres CLONE 1434671-F
  misc_feature: Encodes the peptide sequence at SEQ ID NO. 40890
agagctggagctccccgcggtggcggccgctctagaactagtggatcccccgggctgcaggaattcgcacgagaccattacctagaacatcctaatcgaaaacagctccgcctccctttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagcttcagggagatcaggacgagctcgagaaggttaatgaggaaagcagtgacaaggtttatggaggtggagcagaaatacagtgaggattcgcagacctgtctattctcagagggggtgacattatcaagaccattcccggactttttggctcacaccgtttttgaagccatcctctactaaggggacctttctgactgaaaagggtccaaaaaatttccaggtccttggaaccccattgagggccaagaattcccgaagttaaaggcggggaattccctttttcccctaaaccttcccggaaaacccccctttttttttaaaaaaccaaaagtttttaaaaagaccctttttcctttttggtgagaggggggggccccccccccaaa

SEQ ID NO: 40890 - protein, 61 aa, Zea mays
  misc_feature: Ceres CLONE 1434671-F
MTAPADKGKKAKTDADGGEENEQIDGALVFSIEKLQGDQDELEKVNEESSDKVYGGGAEIQ

SEQ ID NO: 40891 - DNA, 703 bp, Zea mays
  misc_feature: Ceres CLONE 1434674-F
  misc_feature: Translation starting site: 589
  misc_feature: SWISSPROT Homolog: EC 2.7.11.1 Non-specific serine/threonine protein kinase
agagctggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacgacgaggtgtcgcgcatgatggaaggaggcggacgcggacggcgacggctgcatcagcctgcccgagttcgccgcgctcatggagtccgcgtccgccgacgccgccgccgtcgaggaggacctgcgccacgccttcatggtcttcgacgccgacggcaacggcctcatcacgcccgccgagctcgcgcgcgtct

SEQ ID NO: 40892 - DNA, 642 bp, Zea mays
  misc_feature: Ceres CLONE 1434675-F
  misc_feature: Translation starting site: 143
  misc_feature (314)..(314): n is a, c, t, g, unknown, or other
  misc_feature (399)..(399): n is a, c, t, g, unknown, or other
  misc_feature (458)..(458): n is a, c, t, g, unknown, or other
  misc_feature (521)..(521): n is a, c, t, g, unknown, or other
aagctggagctccccgcggtggcggccgctctagatctagtggatcccccgggctgcaggaattctcacgagaccattacctagaacatcctaatcgaaaaattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcncggaagaggccggcgcgtgcgccgtgatggcgctggagcgggtccccgccgacatccgcgcgcagggcgcgtggcgcgcatgtcngacccgggcctcatccgcgacatcaagcgcgccgtcaccatcccggtcatgggcaaggnccgcatccggcacttcgtggaggcccagatcctgggagggcgtgggcgtcgactacgtggacnagagcgaggtgctgacccccggccgacgacgcgcgacacattcacaagcaccactttcgcgtccccctcgtctgcgggtggcccgaacctcggcggagggcctccccaagggggcgcgagg

SEQ ID NO: 40893 - DNA, 746 bp, Zea mays
  misc_feature: Ceres CLONE 1434677-F
  misc_feature: Encodes the peptide sequence at SEQ ID NO. 40894
aaactggagctccccgcggtggcggccgctctagaactagtggatcccccgggctgcaggaattcgcacgagaccattacctagaacatcctaatcgaaaaaatcccaatcccaatcccaatcccaatccacccgcaggtcgcaaactcaacacacagtcagcctcaaacctctttctcgtccgaatccagaacttccatccatggcagtgtcatcagggatggtcttctccgtccgcccgccggctccggcccggccctgcgcttgctctgccacggcgagggcgcgccccgtcggcgacagcgacaagtggggggcgccgcttgctggggtggtccgggcagccggactacatcgacttgcggtcggcgtctcgagacaacgtctcgccttgggggggcgggcctttgcccccccctttcggcccgccccgtttcggccttgtttaactcagcaccaaggggtctgcctcgttcccccttgtttaataaccatgttaattaccgccgaagttttttcccggattttgtttgtactctcttccccgctacgccgcgtccccgaattcgcccgccgctccgtaccctaaacgcccgatgattcaccccgccgccgccctaaattctccacatcccccccgggtggtcgaaaaaaaagcggggggtgcgctggtaaaacattccgcggatccggttttagtttggcggcacaaaagaacaaaaaaaaggcggcctaatctcatgcac

SEQ ID NO: 40894 - protein, 128 aa, Zea mays
  misc_feature: Ceres CLONE 1434677-F
MAVSSGMVFSVRPPAPARPCACSATARARPVGDSDKWGAPLAGVVRAAGLHRLAVGVSRQRLALGGRAFAPPFRPAPFRPCLTQHQGVCLVPPCLITMLITAEVFSRILFVLSSPLRRVPEFARRSVP

SEQ ID NO: 40895 - DNA, 714 bp, Zea mays
  misc_feature: Ceres CLONE 1434678-F
  misc_feature: Encodes the peptide sequence at SEQ ID NO. 40896
aaagctggagctccccgcggtggcggccgctctagaactagtggatcccccgggctgcaggaattcgcacgagaccattacctagaacatcctaatcgaaaaaaatcgagcatcgcagagataggcgtcttcgtactcgcctacctccgcgggtcaaacctttcccccttctcccaattccctccgtcggccgccgctccatcccatacgacgacaccatgagggagtgcatttcgatccacatcggacaggccggtatccaggtcggaaacgcgtgctgggagctgtactgccttgagcatggcattcaggctgaccgtcagatgcccggtgacaagaccattgggggaggtgatgatgctttcaacaccttcatcagtgagactggtgctgggaagcacgtgccccgtgctgtttttgttgaccttgaacccactgtcatcgatgaggtgaggactggcacctaccgtcagctcttccaccctgagcagctcatcagtgggaaggaggatgcacccaacaactttgcctgtggtcactacacccttggcgagggagatggttgacctatgcccatgatctaatcaagaaccttgccaaacaactgccctggtctccagggctttctcggtttcaacgcttttggtggaagaacgggctctgggccttggttccaccaccccaaagcgccggttttgtaacaccaaaaaaaaa

SEQ ID NO: 40896 - protein, 115 aa, Zea mays
  misc_feature: Ceres CLONE 1434678-F
MRECISIHIGQAGIQVGNACWELYCLEHGIQADRQMPGDKTIGGGDDAFNTFISETGAGKHVPRAVFVDLEPTVIDEVRTGTYRQLFHPEQLISGKEDAPNNFACGHYTLGEGDG

SEQ ID NO: 40897 - DNA, 644 bp, Zea mays
  misc_feature: Ceres CLONE 1434679-F
aagctggagctccccgcggtggcggccgctctagaactagtggatcccccgggctgcaggaattcgcacgagaccattacctagaacatcctaatcgaaaaaacttccctctcctacaccagccactccaaacacttgcaactgcactgacttacatgctatgccaccatgggctcctgtacctgcctgtgctccgaacgctaacaaggtagaatcgcaccccaccatgatggcgcttgtctccgccattctatccaaggacctgctctgtgtggagaaggtggtcaccgtccactgcgaggacatctacctgtacaccgacctcatccgtcacaatatgaactacctcctcttccaccgcaagccgatgaatacaaatgaggctggagggcacatccagttccgcgcccccgtcaaaaacctatgacccgtcctccaagatataattccacatcaaactaataccagggaggtccgctctaccgacactcactatctactatcgtctcccggcgacgtacaacacgagcatagattcggactccttgacactcttaacgttcagaccttacagcttgacaccaagtactgcactctcggacagctctctcaggagcaccggttccacctctatgacaacacta

SEQ ID NO: 40898 - DNA, 707 bp, Zea mays
  misc_feature: Ceres CLONE 1434693-F
  misc_feature: Encodes the peptide sequence at SEQ ID NO. 40899
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaagacgagacgcgtgtagctagggttttggtctcgtcgcgcacggctcctgaagcttctagacgttcgaggaggaggaggaggaggggagactcccgccgccgccgaagccatggcgtccaccaaggtgcagcgtatcatgacccagcccatcaacctcatcttccgtttcctccagagcaaagcgcgcatccagatctggctcttcgagcagaaggacctccggattgagggtcgcatcatcggattcgatgagtacatgaacttggtcctcgaagatgctgaggaaatcaacgtcaagaaaaacactaggaagacactgggccggatactcctcaaaggtgacaacataactttgatgatgaacagtggcaagtgaaggttcttatggcaggaacgatgtttggtgctcgcgttgagtatttgtggcacgttgtactccatccattcagacttacatgtataatgtcattgtggattagtgagggagttgtacctgctgttaatgacctgagtaaagtcatgctagatgttgtggcgaanaaaaaaaaaaaaaaagcttatcgataccgtcgacctcgagggggggcccggtaccaattcgccc

SEQ ID NO: 40899 - protein, 88 aa, Zea mays
  misc_feature: Ceres CLONE 1434693-F
  misc_feature (19)..(85): Pfam Name: LSM Pfam Description: LSM domain
MASTKVQRIMTQPINLIFRFLQSKARIQIWLFEQKDLRIEGRIIGFDEYMNLVLEDAEEINVKKNTRKTLGRILLKGDNITLMMNSGK

SEQ ID NO: 40900 - DNA, 638 bp, Zea mays
  misc_feature: Ceres CLONE 1434697-F
  misc_feature: Encodes the peptide sequence at SEQ ID NO. 40901
ggagctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctgggagctccagttgttgttgttacaggtgcctctagagggattggaaaggcaactgctctagcccttggaaaagcaggatgcaagggtctggtaaattatgctcggtcttcgaagaagctgaagagtctccaaaagattgagcatctggtggtgaggctatcacctttggagaagatgttcaaaagagctgatgtagagtctatgatgaaa

SEQ ID NO: 40901 - protein, 140 aa, Zea mays
  misc_feature: Ceres CLONE 1434697-F
  misc_feature: SWISSPROT Homolog: EC 1.1.1.100 3-oxoacyl-[acyl-carrier-protein] reductase
MAAAAAAAAAVSSPIAPRAVAAAASRRGFVTFGGGAARSSPTLRSGRGFSGVQTHVAAVEQAVVKDATKLGAPVVVVTGASRGIGKATALALGKAGCKGLVNYARSSKKLKSLQKIEHLVVRLSPLEKMFKRADVESMMK

SEQ ID NO: 40902 - DNA, 708 bp, Zea mays
  misc_feature: Ceres CLONE 1434698-F
  misc_feature: Translation starting site: 301
aaagctggagctccccgcggtggcggccgctctagaactagtggatcccccgggctgcaggaattcgcacgagaccattacctagaacatcctaatcgaaaaagagagagagagagagagagagcagggctgaagaagttggaggaatcgctgccagtggaaagcggcagcagcagaagcaagaaccagcaagaaaggggagagagaaagccgaaggacttttcctcggattgcatccttcgcttttgagggaaggagaaggaccctctctgtcctcgcggggggcggcaggaggagcagatgttcccgcctggcctgatccaccaccgccctgacgctaccgctcccggcgatgggccaccgcgctccggccccggtgggcctagccttgtactgacggcggaccccaagcccaggctacggtggatggccgacctccactagcgttttgtcgacgccctggtccagctcggcggacccgagaaagcaacccacaaactatcttaaggacgaagggtgtcaaggggcttactcctttccccttgaagagccatcttcagacaaatacgggtaggtaaaaaatctggataaaaagggggtcaaaaaccatcctaaaaaagcctccccattcttctaaaggcctcacaccgggaaaagaggggtttccccccccaaaatgattcccccgcccggaatatgaaaaaaagg

SEQ ID NO: 40903 - DNA, 662 bp, Zea mays
  misc_feature: Ceres CLONE 1434713-F
  misc_feature: Translation starting site: 205
  misc_feature: SWISSPROT Homolog: EC 1.1.1.37 Malate dehydrogenase
aaagctggagctccccgcggtggcggccgctctagaactagtggatcccccgggctgcaggaattcgcacgagaccattacctagaacatcctaatcgaaaaatcccatctgctatccttggttgccgcttcctccaaagccactccaaacccccgcttccagaaccttctcgaaactctccgcctcctcctctactcgctccgatggcgaaggaaccgatgcgcgtgctcgtcactggcgccgcagggcaaattggatatgctcttgttcccatgattgctaggggagttatgcttggtgcagaccagcctgttattctgcacatgcttgatattccgccagcagctgaagcccttaatggtgttaagatggagttggtttgatgctgcatttcctcttctgaagggagtcgttgccaccactgatggtgtgggaagcgggcactggccttgaaggggcccgtcatggttgggtggattcccccgaagggagggaatggaaagaaaaatttttttccctaaaaatggtttaatctaaaaaaccacacctttggtttttgaagcccagggggccccaaaagagaagggttggggggttcccccccccggaaaacccattgttttttattttaaaaaaaatttccccccaaaattccggaagg

SEQ ID NO: 40904 - DNA, 729 bp, Zea mays
  misc_feature: Ceres CLONE 1434716-F
  misc_feature: Translation starting site: 161
  misc_feature: SWISSPROT Homolog: EC 1.2.1.3 Aldehyde dehydrogenase (NAD(+))
  misc_feature (397)..(397): n is a, c, t, g, unknown, or other
  misc_feature (413)..(413): n is a, c, t, g, unknown, or other
aaagctggagctccccgcggtggcggccgctctagaactagtggatcccccgggctgcaggaattcgcacgagaccattacctagaacatcctaatcgaaaacatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgatgccgccaagacatggatggcgattcctgctccnaagcgaggagagatcngtaggcaaaatcgtgatgcactgagagcaaagcttcattcactttggcaggcttgtgtcactggagatgggggaaattcttcctgaagggatcggggaggttcaggaaatcacccacctgtgtgaatattctggggggcttaaccccccacctaaagggatcccttaacccctctggaaccaccaacccttttggtgagggggggggggggctccccctgggagattggggggtgtttaaaccgcgatttaaattcccccttggcccgcgcctttggtggaaaaaccctcacatccttttggcccggagaaaattt

SEQ ID NO: 40905 - DNA, 706 bp, Zea mays
  misc_feature: Ceres CLONE 1434728-F
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaaaccagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaaactgaagcggggcacaggaggaggagaggccgaggcagggagagggttccggcngcgatgggagcgtacaaccccctccgagtgtacgagctcttcgtgcggcacatgaacaa

SEQ ID NO: 40906 - DNA, 583 bp, Zea mays
  misc_feature: Ceres CLONE 1434735-F
  misc_feature: Encodes the peptide sequence at SEQ ID NO. 40907
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
gctccccgcggtggcggccgctctataatagtggatcccccgggctgcaggagagaccattacctagaacatcctaatcgaaaagtccttccctccgcctccgcccccgcccactcctggcttccaccactcctgtcacctcttcccgcgccgacgcagccgccatggaccccgtctccacatgggggctaaccccgctcgcgggcgccgacccggagatctacgacctcctggagcgcgagaagcggcgccagcgtcgcggcatcgagctcatcgcctccgagaacttcacctcccttcgccgtcatggaggcgctcggctccgcgctcactaacaagtactccgagggcatgcccggcgcccgctactacggcggcaacgacgtcatcgacgagatcgagaaccctctgcccgttcnnnacgggccgcgggggcttccctgcccttcacctggacgccccgtcctggggcgtcaaacgtgcaaccctactcggggcttcccccccaaattttgcccgccttaaaccgggggttgttcaaacccgaacaaaacgggaataatgggggcctccaccccctccc

SEQ ID NO: 40907 - protein, 72 aa, Zea mays
  misc_feature: Ceres CLONE 1434735-F
  misc_feature: SWISSPROT Homolog: EC 2.1.2.1 Glycine hydroxymethyltransferase
  misc_feature (38)..(38): Xaa is any aa, unknown, or other
  misc_feature (39)..(39): Xaa is any aa, unknown, or other
MEALGSALTNKYSEGMPGARYYGGNDVIDEIENPLPVXXGPRGLPCPSPGRPVLGRQTCNPTRGFPPKFCPP

SEQ ID NO: 40908 - DNA, 679 bp, Zea mays
  misc_feature: Ceres CLONE 1434736-F
  misc_feature (679)..(679): n is a, c, t, g, unknown, or other
agagctggagctccccgcggtggcggccgctctagaactagtggatcccccgggctgcaggaattcgcacgagaccattacctagaacatcctaatcgaaaaggttctgtttgtttggtgagatgtgttttcctctttctcctacgttgtgagtttccatttggtggacatccttttccagatcccttcgtggattagatccacgctcctctagtcgagatcgtcttgcatttttctgagatggagattgggaccgaaaaggttgcaaaacaatgacctccaactaatacaacccacaacagctgaagaagaaatccagctttctcaaccaccaaatttggaagacaagaccgttgaagagctgctcaacatagatccggatatgtttcccgaagaaggatgtactgttactatatcaagcatcgtgcaaaatagcagatggtggtacccatcttgctccaggtgccacaaatcttcatctcaaacctcaactggatatcactgcacatcatgtggctgcacaaatattaaatttagatacaagctcagcttcattgctactgatggaacatgcgaagcagagttcttttgttttgatagcatagccagaaaaatagtaggagaaccttggggcaaccttgttacagcagttacaacttctgagagtcccagcagcccn

SEQ ID NO: 40909 - DNA, 701 bp, Zea mays
  misc_feature: Ceres CLONE 1434737-F
  misc_feature: Encodes the peptide sequence at SEQ ID NO. 40910
  misc_feature (510)..(510): n is a, c, t, g, unknown, or other
  misc_feature (519)..(519): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaaagccgcgtggacgcacaccagcacctgccctcctcgccgtcgccgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcagttcaaggtgccggactggttcctcaacaggaagaaggattacaaggacggcaggttctcgcaggtcgtctccaacgcccttgatatgaagctcaggnacgaccttngagaggctcagaagatcaggaaccaccgtggtctgcgtcactactggggcctccgcgtccgtggccagcacaccnagactactggtaggcgtggaaagaccgttggtgtctccagaagcgatgagctctatatcacctgaagaaatcttggccgcctaccgggttggttgggtcccaacgct

SEQ ID NO: 40910 - protein, 157 aa, Zea mays
  misc_feature: Ceres CLONE 1434737-F
  misc_feature (14)..(142): Pfam Name: Ribosomal_S13 Pfam Description: Ribosomal protein S13/S18
  misc_feature (109)..(109): Xaa is any aa, unknown, or other
  misc_feature (112)..(112): Xaa is any aa, unknown, or other
  misc_feature (137)..(137): Xaa is any aa, unknown, or other
MSLIAGEDFQHILRLLNTNVDGKQKIMFAMTSIKGVGRRFSNIVCKKADIDMNKRAGELTPDELERLMTVVANPRQFKVPDWFLNRKKDYKDGRFSQVVSNALDMKLRXDLXEAQKIRNHRGLRHYWGLRVRGQHTXTTGRRGKTVGVSRSDELYIT

SEQ ID NO: 40911 - DNA, 709 bp, Zea mays
  misc_feature: Ceres CLONE 1434742-F
  misc_feature: Encodes the peptide sequence at SEQ ID NO. 40912
  misc_feature (402)..(402): n is a, c, t, g, unknown, or other
agagctggagctccccgcggtggcggccgctctagaactagtggatcccccgggctgcaggaattcgcacgagaccattacctagaacatcctaatcgaaaaatctccatcccgcatcgcgcatcgcatccaccgccgagctttctttctttctttctttcttttttctgggagaagaggaagaagaggggaggcgcgacaaaaagggcgccgcgccacgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctgggagcatcccagaccagctttcttcccggcgatgaccnagatcgtcggcacgctcggccccaagtcgcgctccgtcgacaccatctcctcctgcctcaggccggcatgtccgtcgcgcggttcgatttctcgggggagacgcggcctcccaccggaagacgctcgagaaccctcagctcgcattcaagtccacaaaagcttggcccttttttgcttgacccggttggcccggaccttccggtgggcaaaaagagggaaccccccctctccctccaggaaaacggggatttctggtcccccccgcataagggccaaaaaaccccccccccttggtggccaaaaaat

SEQ ID NO: 40912 - protein, 133 aa, Zea mays
  misc_feature: Ceres CLONE 1434742-F
  misc_feature (31)..(31): Xaa is any aa, unknown, or other
MHSTNLLLEEPIRMASILGASQTSFLPGDDXDRRHARPQVALRRHHLLLPQAGMSVARFDFSGETRPPTGRRSRTLSSHSSPQKLGPFLLDPVGPDLPVGKKREPPLSLQENGDFWSPPHKGQKTPPPWWPKN

SEQ ID NO: 40913 - DNA, 649 bp, Zea mays
  misc_feature: Ceres CLONE 1434749-F
  misc_feature: Encodes the peptide sequence at SEQ ID NO. 40914
  misc_feature (257)..(257): n is a, c, t, g, unknown, or other
  misc_feature (265)..(265): n is a, c, t, g, unknown, or other
  misc_feature (266)..(266): n is a, c, t, g, unknown, or other
  misc_feature (296)..(296): n is a, c, t, g, unknown, or other
aagctggagctccccgcggtggcggccgctctagaactagtggatcccccgggctgcaggaattcgcacgagaccattacctagaacatcctaatcgaaaaaaggctccagctttgcgtctgtggccaaccaggcgcctccctcccaccacccggctctccacgccgccgccgccgccgccacaagcgaccgcgcatccgctcttctccctcccttcgctctcggcgggcggcgatgggggagaccgtacgggcggncgacgtcnncatcacgactcacgagatggagagccacancccatcgcactctcagatcgccgacgtgaagatggacatcgcagcgtcagcttctggagcgggcagggagccaagttctgcaagggggcagcccgcggacttcctccgaagccagcaacttccttgaaaggaacccagggaaaaagtccgcctcccataaaagaaactaaataaccccgggggggcccccgcgcgcccaatttcatgcccttaaaagtgggggggggggattaaggggaaaaagcctggggattcttgaaacaaggggggcaccccccgtgtggaaaggggggggggtttccccacccccccggtttccccccccggggcccccgggggggaaggcaaacccc

SEQ ID NO: 40914 - protein, 62 aa, Zea mays
  misc_feature: Ceres CLONE 1434749-F
  misc_feature (8)..(8): Xaa is any aa, unknown, or other
  misc_feature (11)..(11): Xaa is any aa, unknown, or other
  misc_feature (21)..(21): Xaa is any aa, unknown, or other
MGETVRAXDVXITTHEMESHXPSHSQIADVKMDIAASASGAGREPSSARGQPADFLRSQQLP

SEQ ID NO: 40915 - DNA, 799 bp, Zea mays
  misc_feature: Ceres CLONE 1434751-F
  misc_feature: Translation starting site: 226
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (54)..(54): n is a, c, t, g, unknown, or other
  misc_feature (55)..(55): n is a, c, t, g, unknown, or other
  misc_feature (440)..(440): n is a, c, t, g, unknown, or other
ggttttttttttgccccccccccccccccccccctcctaaaannncccgggggnnggacagaactggcactccccgcggtggcggccgctctagaactagtggatcccccgggctgcaggaattcgcacgagaccattacctagaacatcctaatcgaaaaaatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgccaacaacatggatgggacatacactcactcatcatgtctttggaactttcacccaaattnaaaatcaagacctgccaattttttggaaacttcatggggccccaccccgggcgctaggtaatgggtccccccgcccttgtggccgaccccaagggagttcccgccccccaaagggaaaatttttcccccagatggtttttttctttgccccccccccaaaaaaaaggggtaatttttgtgccccccacggagaatactttttccatttcgctttgaaccaaaaaaaaaattgtgaaaccccttgcccccccgtttattttttgccctcgggaaaacaccccccccgaggcgctcttttttggcgccccccacaccaccaggtttttgtggaaaaccccgctcctcccagggaagaaccg

SEQ ID NO: 40916 - DNA, 705 bp, Zea mays
  misc_feature: Ceres CLONE 1434752-F
  misc_feature: Encodes the peptide sequence at SEQ ID NO. 40917
  misc_feature (1)..(1): n is a, c, t, g, unknown, or other
  misc_feature (16)..(16): n is a, c, t, g, unknown, or other
  misc_feature (26)..(26): n is a, c, t, g, unknown, or other
  misc_feature (27)..(27): n is a, c, t, g, unknown, or other
  misc_feature (35)..(35): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (101)..(101): n is a, c, t, g, unknown, or other
  misc_feature (103)..(103): n is a, c, t, g, unknown, or other
  misc_feature (105)..(105): n is a, c, t, g, unknown, or other
  misc_feature (127)..(127): n is a, c, t, g, unknown, or other
  misc_feature (129)..(129): n is a, c, t, g, unknown, or other
  misc_feature (134)..(134): n is a, c, t, g, unknown, or other
  misc_feature (137)..(137): n is a, c, t, g, unknown, or other
  misc_feature (140)..(140): n is a, c, t, g, unknown, or other
  misc_feature (142)..(142): n is a, c, t, g, unknown, or other
  misc_feature (148)..(148): n is a, c, t, g, unknown, or other
  misc_feature (150)..(150): n is a, c, t, g, unknown, or other
  misc_feature (151)..(151): n is a, c, t, g, unknown, or other
  misc_feature (153)..(153): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (159)..(159): n is a, c, t, g, unknown, or other
  misc_feature (325)..(325): n is a, c, t, g, unknown, or other
  misc_feature (416)..(416): n is a, c, t, g, unknown, or other
  misc_feature (417)..(417): n is a, c, t, g, unknown, or other
  misc_feature (442)..(442): n is a, c, t, g, unknown, or other
ncccggcccccaagcncctttccccnnttgaggantcttgggggnnntcagactggagctcacgtggggggggggggggttcttaagcttctttgggaggngnangttttacacgaccccctcggcnanaacanccnaancnaaaaancnncncnnncnccttcccctcccaacgcgcgttccccaaattctcccaccctactagaaatccccaggggggggggggcgccgtccatcggattcgatcctcctagcgagtcgactccatctgatcggcggagccggggcaccagccaccatgtgggcggcatcgtgcctggcgtcntgctgctcggcgtgcgcgtgcgaggcgtgccggacggcggtcggcagcatcggccgccgctccgcccgcatcgcctactgtctcctcttcnngctctggggggggggagggtgggcnctccgcgaggtcgccgcccccctcctccagtcgatcccatggattaaccacttccacaagacccccgaccgcgagtggttcgagaccgacgcggtgctcagggtcagcctcggcaacttcctcttcttcaccatcctcgccgtcatcatggccgggataaaggaccagaaggacccccgtgacaagatccaccacggcggatggatggccaagatcttctgctgggtcatcatcgtcttcctcatgttcttcgtgcccaacgg

SEQ ID NO: 40917 - protein, 135 aa, Zea mays
  misc_feature: Ceres CLONE 1434752-F
  misc_feature (8)..(135): Pfam Name: Serinc Pfam Description: Serine incorporator (Serinc)
  misc_feature (40)..(40): Xaa is any aa, unknown, or other
MWAASCLASCCSACACEACRTAVGSIGRRSARIAYCLLFXLWGGGGWALREVAAPLLQSIPWINHFHKTPDREWFETDAVLRVSLGNFLFFTILAVIMAGIKDQKDPRDKIHHGGWMAKIFCWVIIVFLMFFVPN

SEQ ID NO: 40918 - DNA, 697 bp, Zea mays
  misc_feature: Ceres CLONE 1434753-F
  misc_feature: Encodes the peptide sequence at SEQ ID NO. 40919
  misc_feature (220)..(220): n is a, c, t, g, unknown, or other
  misc_feature (390)..(390): n is a, c, t, g, unknown, or other
  misc_feature (392)..(392): n is a, c, t, g, unknown, or other
  misc_feature (407)..(407): n is a, c, t, g, unknown, or other
  misc_feature (408)..(408): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (452)..(452): n is a, c, t, g, unknown, or other
  misc_feature (521)..(521): n is a, c, t, g, unknown, or other
  misc_feature (522)..(522): n is a, c, t, g, unknown, or other
  misc_feature (524)..(524): n is a, c, t, g, unknown, or other
  misc_feature (526)..(526): n is a, c, t, g, unknown, or other
  misc_feature (531)..(531): n is a, c, t, g, unknown, or other
  misc_feature (549)..(549): n is a, c, t, g, unknown, or other
  misc_feature (556)..(556): n is a, c, t, g, unknown, or other
  misc_feature (560)..(560): n is a, c, t, g, unknown, or other
  misc_feature (586)..(586): n is a, c, t, g, unknown, or other
  misc_feature (601)..(601): n is a, c, t, g, unknown, or other
  misc_feature (605)..(605): n is a, c, t, g, unknown, or other
  misc_feature (616)..(616): n is a, c, t, g, unknown, or other
  misc_feature (623)..(623): n is a, c, t, g, unknown, or other
  misc_feature (626)..(626): n is a, c, t, g, unknown, or other
  misc_feature (636)..(636): n is a, c, t, g, unknown, or other
  misc_feature (647)..(647): n is a, c, t, g, unknown, or other
  misc_feature (652)..(652): n is a, c, t, g, unknown, or other
  misc_feature (653)..(653): n is a, c, t, g, unknown, or other
  misc_feature (657)..(657): n is a, c, t, g, unknown, or other
  misc_feature (658)..(658): n is a, c, t, g, unknown, or other
  misc_feature (663)..(663): n is a, c, t, g, unknown, or other
  misc_feature (669)..(669): n is a, c, t, g, unknown, or other
  misc_feature (673)..(673): n is a, c, t, g, unknown, or other
  misc_feature (675)..(675): n is a, c, t, g, unknown, or other
  misc_feature (678)..(678): n is a, c, t, g, unknown, or other
  misc_feature (693)..(693): n is a, c, t, g, unknown, or other
  misc_feature (697)..(697): n is a, c, t, g, unknown, or other
ggcggccgctctagaactagtggatcccccgggctgcaggaattcgcacgagaccattacctagaacatcctaatcgaaaacctagccgcctgcctctcctcctccagagctcgtcgccaccggccaccgccaccctcgatcacgccgtccgtcgaggtaaggtcagcatggtgagggtcagtgtgctcaacgatgcgctcaagtccatgtacaacgctngagaagatcggcaagaggcaggtcatgatcaggccgtcgtccaaggtcaggatcaagttcctgacggtcatgcagcgccacggctacattggagagttcgagtacctttgatcaccaccgatccggggaggatgtgggtcaaagtcaacggggaggctaaaccagtgccncnccccccccccccccnnaggggagaggggnnnnggggggtgggggggggggagggggagancgcgcggtgcgggatgggggggggggggcaggagaggagcgagggggggggggagtctatttagtcagnngngnagagnggggcgagcggagagggnggggcgntgtnagaaaagaagaagtggggggaagacnttttctacatcggcnccgngggttttgaanacgcggngcnccgagcgctnacttctgttantaggnngaanncgtanagtgtntggnanggnaatgataggacaganggcn

SEQ ID NO: 40919 - protein, 45 aa, Zea mays
  misc_feature: Ceres CLONE 1434753-F
MRSSPCTTLEKIGKRQVMIRPSSKVRIKFLTVMQRHGYIGEFEYL

SEQ ID NO: 40920 - DNA, 716 bp, Zea mays
  misc_feature: Ceres CLONE 1434763-F
  misc_feature: Translation starting site: 239
  misc_feature: Pfam Name: Mo-co_dimer Pfam Description: Mo-co oxidoreductase dimerisation domain
agagctggagctccccgcggtggcggccgctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgtggggcgccccccgccggtgtacatcatcgccgaggtcaacctgtcaccgcttcaacccctgggaacctgccggagcgcgccctcatacgccgccgcaagtggtatttcttcacaccgcgggaccgtaaggaccccaatggggtcccgtccaaaccgcgccaaccggccggggtatttgcacgccaccggcccagaacaacccctttgacccacgcggggccgaaatggcgggaaacccaaaagggcccccgagattccccgacgggaaatctcccccccggggggaaaaaaaagggaatggtaacaccgccacaaaaacagaacccccacgaggaaaacaaaaaaaa

SEQ ID NO: 40921 - DNA, 671 bp, Zea mays
  misc_feature: Ceres CLONE 1434768-F
aaagctggagctccccgcggtggcggccgctctagaactagtggatcccccgggctgcaggaattcgcacgagaccattacctagaacatcctaatcgaaaaattctcttgcctgctgcggcgagagcacttcggccaaggaagagcaccaactgcctgcggcacctacgattgtcttccctctgcaatggttgtcatcatgggtatgggattgcagactcccttgaagaggctcaatgcccccaaggattggatgatcgacaagcttggcggagctttagctctcctccttctgctggacctcctccgtccatggagtgtcttcctctgatcctcatcatcgcgaatccgctcgattctgctcttaactacccttagcctcctcctatccttactcctccacatgtacttcctcatcccaaggctccgactcacaacacctctcctgctgcgttcactgctccacttttcatctctcatcctctggaaaatactccgctactttatcacacatcgcccgcttccatcttccaccactcggtcatacgatgccaagttctccctctgcatcgcgaggtctgttcagcctcgcagagagacttcccctacttgaacacctactaagggcgcaccatcttctacaccgacgcgttcatcgagggcagcgactc

SEQ ID NO: 40922 - DNA, 659 bp, Zea mays
  misc_feature: Ceres CLONE 1434772-F
  misc_feature: Encodes the peptide sequence at SEQ ID NO. 40923
aagctggagctccccgcggtggcggccgctctagaactagtggatcccccgggctgcaggaattcgcacgagaccattacctagaacatcctaatcgaaaaatcttcgtgaggaccttcaaccatctcaggcggaatggcggcttctggtgagggcgcgtcgctgccgtctccggcgggcggggaggatgcgcaccgccgccgcgtcagctatttctacgagccgtcgatcggagactactactacgggcaaggtcacccgatgaagccccaccgcatccgaatggcgcactcgctggtggtccactacggcctccaccgcctcctcgagctctcccgcccctacccggcctctgaggccgacatccgccgcttccactccgacgactacgtcgccttcctcgcgtccgccaccggaaacccgggtgtcctcgacccgcgcgccattaagcgctttaacgtcggtgaggactgccccgtgttcgacggtctcttccccttctgccaggcctccgctgggggaagcatcggcgccgccgtcaagcttaaccgcggggacgccgacatcaccgtcaactgggcgggcggcctccaccacgcccaagagaacgagggcctccgggttctgtatctttaaaagaatttggccccccccctccc

SEQ ID NO: 40923 - protein, 166 aa, Zea mays
  misc_feature: Ceres CLONE 1434772-F
  misc_feature (23)..(167): Pfam Name: Hist_deacetyl Pfam Description: Histone deacetylase domain
MAASGEGASLPSPAGGEDAHRRRVSYFYEPSIGDYYYGQGHPMKPHRIRMAHSLVVHYGLHRLLELSRPYPASEADIRRFHSDDYVAFLASATGNPGVLDPRAIKRFNVGEDCPVFDGLFPFCQASAGGSIGAAVKLNRGDADITVNWAGGLHHAQENEGLRVLYL

SEQ ID NO: 40924 - DNA, 589 bp, Zea mays
  misc_feature: Ceres CLONE 1434782-F
  misc_feature: Encodes the peptide sequence at SEQ ID NO. 40925
  misc_feature (276)..(276): n is a, c, t, g, unknown, or other
  misc_feature (287)..(287): n is a, c, t, g, unknown, or other
aaagctggagctccccgcggtggcggccgctctagaactagtggatcccccgggctgcaggaattcgcacgagaccattacctagaacatcctaatcgaaaaaaaaggggaaaaggggctggtgcgcaaaaccctagcacagtcgcatccatcatggcgatgtccatcttcggcggctgcgtcggcggcgactccggtgcgctcatcgcgccgtccgcgtcctcgctccgcccgccgttccgtcttgtcgctggtcccaagggccatttttgtacnttttcctcatngggagcatcctaacatcacagcggttatgtgtcacatcaaagggtcccgcaagctccacccagaactatgctttttccaagaaaggatttttttcccctaaaccccaaaaagggaaaggttcccccccaacagtgttaaacaggggttttcctcacccccgaaaaatagcgggaaaaaaaaagtgttttttcccccacccaaaaagagaccccccctgggaaaatcctcaaaaaaaaaggttttaaaaaaaacccctctctccccccccccggggtgtgaaaaacccggtttaaagccaaaa

SEQ ID NO: 40925 - protein, 48 aa, Zea mays
  misc_feature: Ceres CLONE 1434782-F
  misc_feature (45)..(45): Xaa is any aa, unknown, or other
MAMSIFGGCVGGDSGALIAPSASSLRPPFRLVAGPKGHFCTFSSXGAS

SEQ ID NO: 40926 - DNA, 722 bp, Zea mays
  misc_feature: Ceres CLONE 1434784-F
  misc_feature: Encodes the peptide sequence at SEQ ID NO. 40927
  misc_feature (532)..(532): n is a, c, t, g, unknown, or other
  misc_feature (709)..(709): n is a, c, t, g, unknown, or other
  misc_feature (722)..(722): n is a, c, t, g, unknown, or other
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcanggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgcgccgctctcggtcatgaaattggtgatccagacaangagcgtggaatcn

SEQ ID NO: 40927 - protein, 164 aa, Zea mays
  misc_feature: Ceres CLONE 1434784-F
  misc_feature (9)..(98): Pfam Name: MtN3_slv Pfam Description: MtN3/saliva family
  misc_feature (101)..(101): Xaa is any aa, unknown, or other
  misc_feature (160)..(160): Xaa is any aa, unknown, or other
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRXVVLLFAAEVAFVVALAALVLTLAHTHERRSMLVGIVSVFFGTGMYAAPLSVMKLVIQTXSVES

SEQ ID NO: 40928 - DNA, 705 bp, Zea mays
  misc_feature: Ceres CLONE 1434788-F
  misc_feature: Translation starting site: 279
  misc_feature (567)..(567): n is a, c, t, g, unknown, or other
  misc_feature (705)..(705): n is a, c, t, g, unknown, or other
aagctggagctccccgcggtggcggccgctctagaactagtggatcccccgggctgcaggaattcgcacgagaccattacctagaacatcctaatcgaaaacactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcaccggaagcatcccggaggtcgcggtaacgccgggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccgtcggcgacaggccccgcagatcgacgtcacgcagttcggctacttcaagtgctcgggaagggggtgctgccgcccaagcccatcgtcgtcaaggccaagctcatctccaaggtcgccgagaagaagatncaagccgccgggcggcgccgtcgtgctcacccgctagttttcagtcctttatcgccctctggttttgagatctatatctggactagcagtgctttcctgtctcacctatttgtgttaagaagacgtagttttttaatn

SEQ ID NO: 40929 - DNA, 727 bp, Zea mays
  misc_feature: Ceres CLONE 1434800-F
  misc_feature: Encodes the peptide sequence at SEQ ID NO. 40930
aagctggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggtgatggaactacaactgcctctgttctcgctagggagatcatcaaattgggcatgttgagcattacttcaggggcaaatccagtgtccgttaagaagggcattgataagactgttcagaaattggtggaggaacttgagaagaatcaaggccgggtcagggtagtggggatat

SEQ ID NO: 40930 - protein, 188 aa, Zea mays
  misc_feature: Ceres CLONE 1434800-F
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMLSITSGANPVSVKKGIDKTVQKLVEELEKNQGRVRVVGI

SEQ ID NO: 40931 - DNA, 721 bp, Zea mays
  misc_feature: Ceres CLONE 1434804-F
  misc_feature: Translation starting site: 348
  misc_feature (587)..(587): n is a, c, t, g, unknown, or other
aaagctggagctccccgcggtggcggccgctctagaactagtggatcccccgggctgcaggaattcgcacgagaccattacctagaacatcctaatcaaaaaagcttgttgctgctgctgaaggaaaagacaattttctccttacctcctgggctcaggcctcaggcgcacagccttctgcttctcttcctctcctcgcgtccccccaccaaaccctaacccgagcacccagcccctcctcgcgtctgctcgcgccggcctttggggctctcactctgagcggcagggacccgcagggctccggttgtgtccaggaaacatcccagttgttggcgagagaccaagaaatggcggagaaggagggagcgaaggttggagcggaagagatggaagagcgggagcaggaaggggaggcagaggaggtggaggtgaagtttcgtctcttcgatggctctgacatcggtcccgtgcgctgcaacgccgccgccactaccgtagccgccctcaaggatcgcgtcgtcgccgattggcccaagataaatcaattatccccaagactgctagtgatgtgaaactaataagtggangcaaaattctagaaaatgacaagaaatgtgcacagtgcagagctccttttggtatcttcccagtagtgctatcacgatgcatggtggtgtccaacatcgtccgcaaatcaaaccccaattaaaaggccaacaat

SEQ ID NO: 40932 - DNA, 736 bp, Zea mays
  misc_feature: Ceres CLONE 1434811-F
  misc_feature: Encodes the peptide sequence at SEQ ID NO. 40933
  misc_feature (59)..(59): n is a, c, t, g, unknown, or other
  misc_feature (105)..(105): n is a, c, t, g, unknown, or other
  misc_feature (121)..(121): n is a, c, t, g, unknown, or other
  misc_feature (359)..(359): n is a, c, t, g, unknown, or other
  misc_feature (360)..(360): n is a, c, t, g, unknown, or other
  misc_feature (375)..(375): n is a, c, t, g, unknown, or other
  misc_feature (378)..(378): n is a, c, t, g, unknown, or other
  misc_feature (427)..(427): n is a, c, t, g, unknown, or other
  misc_feature (449)..(449): n is a, c, t, g, unknown, or other
  misc_feature (455)..(455): n is a, c, t, g, unknown, or other
aagctggagctccccgcggtggcggccgctctagaactagtggatcccccgggctgcanggaattcgcacgagaccattacctagaacatcctaatcaaaaatantctcctcaaggcacgnttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgnncgcgaggcggcgacntcncgacggaagcggacgacgagttcatgatgcacgagttcaaggtgcggcngtgccccccccccccaaccacnaatggnaggggtgccctacccccccccgggggaagcccgccgggggggggaacccccccggggggccaccggggggaacctgttcccgaatttcgggcccccccggggcgggggccccgggtcccccgggggccccccttcccctcctcccagggaacttttaaggtgggtgtcccccctccccataaaaaagccccctttttgggggggggtcttttcccccccccctttttttttttttccccccgcgggaaatttccccggggggcgggggggggggggggaac

SEQ ID NO: 40933 - protein, 169 aa, Zea mays
  misc_feature: Ceres CLONE 1434811-F
  misc_feature (45)..(45): Xaa is any aa, unknown, or other
  misc_feature (50)..(50): Xaa is any aa, unknown, or other
  misc_feature (51)..(51): Xaa is any aa, unknown, or other
  misc_feature (67)..(67): Xaa is any aa, unknown, or other
MVSRENLHLVLDPASLGAPWADPSAAEIPPQLLAALGEYLSSTRXRGGDXXTEADDEFMMHEFKVRXCPPPPTTNGRGALPPPGGSPPGGGTPPGGHRGEPVPEFRAPPGRGPRVPRGPPFPSSQGTFKVGVPPPHKKAPFLGGGLFPPPFFFFSPRGKFPRGAGGGGG

SEQ ID NO: 40934 - DNA, 700 bp, Zea mays
  misc_feature: Ceres CLONE 1434814-F
  misc_feature: Encodes the peptide sequence at SEQ ID NO. 40935
  misc_feature (598)..(598): n is a, c, t, g, unknown, or other
  misc_feature (617)..(617): n is a, c, t, g, unknown, or other
  misc_feature (656)..(656): n is a, c, t, g, unknown, or other
aagctggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagagagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaatgaaaggagctgtncagaaagcggaagagatancagcaaagacacccaactcttacatccttttcacatttngaaaatccagctaacccaaagattcactatgagactactgggcc

SEQ ID NO: 40935 - protein, 155 aa, Zea mays
  misc_feature: Ceres CLONE 1434814-F
  misc_feature (12)..(155): Pfam Name: PALP Pfam Description: Pyridoxal-phosphate dependent enzyme
  misc_feature: SWISSPROT Homolog: EC 2.5.1.47 Cysteine synthase
  misc_feature (139)..(139): Xaa is any aa, unknown, or other
  misc_feature (152)..(152): Xaa is any aa, unknown, or other
MGEASPSIAKDVTELIGNTPLVYLNKVTEGCVGRVAAKLESMEPCSSVKDRIGYSMITDAEERGLITPGVSVLIEPTSGNTGIGLAFMAAAKGYKLTLTMPASMSMERRIILKAFGAELVLTDPLLGMKGAVQKAEEIXAKTPNSYILFTFXKSS

SEQ ID NO: 40936 - DNA, 676 bp, Zea mays
  misc_feature: Ceres CLONE 1434816-F
  misc_feature: Encodes the peptide sequence at SEQ ID NO. 40937
  misc_feature (426)..(426): n is a, c, t, g, unknown, or other
ggagctccccgcggtggcggccgctctagaactactggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgttgaacaacactgcagtgagcgacggcaggcatggtgagccgtgaaaatttgcacctggtgctaggacccggcgatctctgggcgcgccttgtgccgacccgtccgccgcagagatccctgcgcagctcctcgccgcgctgggagagtacctctcctcccgccgcggcgacgtcgagacggatgcggacgactagttcatgatgcacgagttcatgtgcggacgtgcgcgcacctctgaatcacnactggacggcgtgcccctacgcgcacccgggggagccacgctgacgcgggacccgccccccgtggtctaagcgggggaagccgggccggactttcggggccgcccgggtcccggcagccagttgccaaacggggtcccgcttgcccgatcccaaaagggacctttcaagctgttggttccacccgttccggttaccggacgaaaccccttgcccggggggggctaccatgcctcccgccggtttttgcat

SEQ ID NO: 40937 - protein, 38 aa, Zea mays
  misc_feature: Ceres CLONE 1434816-F
  misc_feature (16)..(16): Xaa is any aa, unknown, or other
MMHEFMCGRARTSESXLDGVPLRAPGGATLTRDPPPVV

SEQ ID NO: 40938 - DNA, 724 bp, Zea mays
  misc_feature: Ceres CLONE 1434821-F
aaagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctcgatgctctccccatcgacacgcgagccccttggaggggccccgacctagattttactgag

SEQ ID NO: 40939 - DNA, 732 bp, Zea mays
  misc_feature: Ceres CLONE 1434828-F
  misc_feature: Translation starting site: 201
  misc_feature (275)..(275): n is a, c, t, g, unknown, or other
  misc_feature (276)..(276): n is a, c, t, g, unknown, or other
  misc_feature (375)..(375): n is a, c, t, g, unknown, or other
  misc_feature (652)..(652): n is a, c, t, g, unknown, or other
aagctggagctccccgcggtggcggccgctctagaactagtggatcccccgggctgcaggaattcgcacgagaccattacctagaacatcctaatcaaaaaaaacaaaaaccctagccgccgcgccgccccgctccctagtggtcctccctcccccaccactgcagctccgtcccggcggccccaagagttgcggcgaggatgaacgtgaagggcggcagccggattccggtaccccctccgggggccagcgcgctggtcaaggtggccgtgttnncggcggcgccgccgtgtacgctgccgtgaacagcctctacaacgtcgagggtgggcaccgcgccatcgtctttcaccgcatccaggggaatcaggacanggtataccccgaagggactcactttatgattccatggtttgaacgaccaatcatttatgatgtccgtgctcgaccgaatctttgtgagagtacttctgggagtcgggatcttcagatggtgaaaattggtctccgtgtccttacaaggcctatgccagagaggctaccacatatctacagaactctgggagagaactttcatgagagagttttgccttcatcatccatgaaaacactgaagctgtgtgctcaatatatgctagtcagctgatcaccnagagagactgtgagtagggagatttagagatactgactgagagggctagatccctcacatttgctctgatgacgtctcac

SEQ ID NO: 40940 - DNA, 689 bp, Zea mays
  misc_feature: Ceres CLONE 1434838-F
  misc_feature: Encodes the peptide sequence at SEQ ID NO. 40941
  misc_feature (336)..(336): n is a, c, t, g, unknown, or other
  misc_feature (462)..(462): n is a, c, t, g, unknown, or other
  misc_feature (467)..(467): n is a, c, t, g, unknown, or other
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccgggcgtcaagtccatcccgtccatcttccaccacccgccggaagccctgagcgacataatttctccggcgcctctgccngcgtcgccgccctccggcgccccgcatccggtggtggacctctcggtgacgcggcgcgaggacctagtcgagcaggtgaggcacgcggccgggacggtgggcttcttctggctggtgaacacggantgccngaagaactgatgggcggcatgctccgcggggtgcgccagttcacgagggccccgtgggaggcgaaccaggcgctctacttccagggacctcgcttcgcaaccttggggcttcgccttccaactttcaactttttttaaagtttgcttgcggccaattgggcccaaacccctccttcggcaaggggggtcccaaccccccccccccgggaagaaactcccgaa

SEQ ID NO: 40941 - protein, 152 aa, Zea mays
  misc_feature: Ceres CLONE 1434838-F
  misc_feature: SWISSPROT Homolog: EC 1.14.11.20 Desacetoxyvindoline 4-hydroxylase
  misc_feature (64)..(64): Xaa is any aa, unknown, or other
  misc_feature (106)..(106): Xaa is any aa, unknown, or other
MAPTTATKDDSGYGDERRRELQAFDDTKLGVKGLVDSGRQVHPVHLPPPAGSPERHNFSGASAXVAALRRPASGGGPLGDAARGPSRAGEARGRDGGLLLAGEHGXPEELMGGMLRGVRQFTRAPWEANQALYFQGPRFATLGLRLPTFNFF

SEQ ID NO: 40942 - DNA, 703 bp, Zea mays
  misc_feature: Ceres CLONE 1434844-F
  misc_feature: Encodes the peptide sequence at SEQ ID NO. 40943
aagctggagctccccgcggtggcggccgctctagaactagtggatcccccgggctgcaggaattcgcacgagaccattacctagaacatcctaatcggaaaaacacaaactagaagcttgcattgttcgtttgctcgatcgttgcatataatggagaaccctgctccgagtatcgaagtgccccccattgccgcacctgtatcagcgaacttcagcagactcgccttccgcaacctgtacatccgacggacgggtccagacagcaagaacatggtgactgtggagggaagaaaacgctctagtgatcacacaggcgacatgaggtacgtgagtgacttccccgtctacgatggccgtggctccgacgccgtcctgatggctcgcgtgcagggcgtcacaaccacgttcgggaactccaaccagttcttcaccgtcaccttcgaggccggcaggctcaagggctccacgctccttaccgaacgagtggtgactgatggatcagatgaatggacaatctacggcgggacccgacagattgctatggctagatgtgtcttcaaaagaacgtaccttgccgatagggatggcgccaggaacactgacaagctcatcatgcaggttttctgcccggtgtttggctcatcacagcaaccaaacaagcaggactccagcatctctgtcacccagattgggttatggcgtg

SEQ ID NO: 40943 - protein, 184 aa, Zea mays
  misc_feature: Ceres CLONE 1434844-F
MENPAPSIEVPPIAAPVSANFSRLAFRNLYIRRTGPDSKNMVTVEGRKRSSDHTGDMRYVSDFPVYDGRGSDAVLMARVQGVTTTFGNSNQFFTVTFEAGRLKGSTLLTERVVTDGSDEWTIYGGTRQIAMARCVFKRTYLADRDGARNTDKLIMQVFCPVFGSSQQPNKQDSSISVTQIGLWR

SEQ ID NO: 40944 - DNA, 756 bp, Zea mays
  misc_feature: Ceres CLONE 1434849-F
  misc_feature: Encodes the peptide sequence at SEQ ID NO. 40945
  misc_feature (171)..(171): n is a, c, t, g, unknown, or other
  misc_feature (172)..(172): n is a, c, t, g, unknown, or other
  misc_feature (366)..(366): n is a, c, t, g, unknown, or other
aaagctggagctccccgcggtggcggccgctctagaactagtggatcccccgggctgcaggaattcgcacgagaccattacctagaacatcctaatcgaaactgccactccactcctaccccacacagaagcggcggcggcggagcaaacgcaggcgaaggcgagggtgtnngagggaaggagcaccagccatggtgcacgtcaacttctaccgcaactatagtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcanggcacttgctcacccttgacgagagaacccccgtcgtattcttgagggggaggcgcttcctcccccccatgacccctttgggcttgcctgctaagggcaaaacaagccttgtttttgttcttgccccccccgcttaaaaattcccctccaaggggggttcaaaacttttttttttagggggggggggggcaaatccttttcccaggtgctgggttttgtttaaaacgccctccatcggggggggggggaaattttcccccccccccccttttgggggggggggggggttaaaaaaaacttttttttttttttttgggaacccctttttggggggccccccccgggggggggagaaaaaaaaaaaaaaaaagaaccgggcgggcgggcgta

SEQ ID NO: 40945 - protein, 103 aa, Zea mays
  misc_feature: Ceres CLONE 1434849-F
  misc_feature (7)..(100): Pfam Name: Ribosomal_S4 Pfam Description: Ribosomal protein S4/S9 N-terminal domain
  misc_feature (59)..(59): Xaa is any aa, unknown, or other
MVHVNFYRNYSKTFKKPRRPYEKERLDAELKLVGEYGLRCKRELWRVQYALSRIRNAAXHLLTLDERTPVVFLRGRRFLPPMTPLGLPAKGKTSLVFVLAPPA

SEQ ID NO: 40946 - DNA, 735 bp, Zea mays
  misc_feature: Ceres CLONE 1434852-F
  misc_feature: Encodes the peptide sequence at SEQ ID NO. 40947
  misc_feature (538)..(538): n is a, c, t, g, unknown, or other
aagctggagctccccgcggtggcggccgctctagaactagtggatcccccgggctgcaggaattcgcacgagaccattacctagaacatcctaatcgaaaaaaatcaccttcacctcgccgcttgctccttgaccgcctcagttcgacatcgtcttccggcgaggtagctcgcccgaagacctcagctggacttttcgagacacaccctccacacactctcttaccctcgggagtggccgcctgcgttctagctcgtcgacgccccaatctacgtgtgcttcctctacagccccatccgcttcttctcgctctcgctaggggtcctctgcgtgttcgccatggcgatccgcatcaccgtctcctactccggctacgtggcgcataaccacgccgcgtcgctcggctaccgcgtcacctccgccaccgcctcgggcagccgcttccagcatgacggcgcctgacgccccttctgcatcttcacgtcggcccgccagttggagcagctcagcggcagcggctccgatcgccttgacagangcgacaacacctacgcgaagccccaggccatcgccgccggagctcactcgctgctgctcacgcgagcgtgctgatcggcgaagtcaacgtcgccgtctcttggcgtgtggctgctcgcggtgcttgcgcagaggaccggacccaccctggaaccaccggagctgcggattctgtctcaggctcttgcccgacttccc

SEQ ID NO: 40947 - protein, 40 aa, Zea mays
  misc_feature: Ceres CLONE 1434852-F
MAIRITVSYSGYVAHNHAASLGYRVTSATASGSRFQHDGA

SEQ ID NO: 40948 - DNA, 675 bp, Zea mays
  misc_feature: Ceres CLONE 1434883-F
  misc_feature: Encodes the peptide sequence at SEQ ID NO. 40949
  misc_feature (640)..(640): n is a, c, t, g, unknown, or other
aagctggagctccccgcggtggcggccgctctagatctagtggatcccccgggctgcaggaattcgcacgagaccattacctagaacatcctaatcgaaaaacattcacatcgcactctcctccagcctccaggcttggcaagcgtgcttcaacatgaccacatccatgtcgaacagcgccgctagcgagaagcaagcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcgtggacctcggcgagttcagggcgttccacgcgcgcggcggctgcggcgtggacgacgacgccgagctccgcgccgccttcgacgtctacgacgtcgacggcgacggccgcgtcacggcggccgagctgggcaaggtgctcgcgcgcatcggcgaaggcggatgcagcgccgaggagtgcgagcggatggtcgccggcgtcaatgccgaacgctgcgtcggnttcgaggacttcaagaagatgatgtgcccccagcc

SEQ ID NO: 40949 - protein, 169 aa, Zea mays
  misc_feature: Ceres CLONE 1434883-F
  misc_feature (106)..(134): Pfam Name: efhand Pfam Description: EF hand
  misc_feature (29)..(57): Pfam Name: efhand Pfam Description: EF hand
  misc_feature (69)..(97): Pfam Name: efhand Pfam Description: EF hand
  misc_feature: SWISSPROT Homolog: EC 2.7.11.1 Non-specific serine/threonine protein kinase
MSNSAASEKQAQQAGHRQRPPAASAADAEMQRVFCRIDADGDGRISASELAAVTRAISPPASSSHGRREVAAMMDELDTDRDGFVDLGEFRAFHARGGCGVDDDAELRAAFDVYDVDGDGRVTAAELGKVLARIGEGGCSAEECERMVAGVNAERCVGFEDFKKMMCPQ

SEQ ID NO: 40950 - DNA, 744 bp, Zea mays
  misc_feature: Ceres CLONE 1434921
  misc_feature: Encodes the peptide sequence at SEQ ID NO. 40951
ctcgcttctcttcctcccaagcaaccgcttctagccgggcgccggcggcagctaccacgtgccgccaccgtctcatcgcctcgccgtactagccccgcggcttcgtcgtccgatgagccgctgccctgtttcctctcatacaatataatggtgtcaaagcctgtagtgcttgtcttcctgttggtggtactcataatcacgtcccagtttgaatggaagcaacagcttgtaaacgagttggaatctacggctcgcaaccagaaacatgtttcaagtagagaagagcttgtcaaggatcagataatcttcactcaagaaaagatgattcaaagattgaataattttgtccagaatcttcagcaacagttggtgcagtgtcgtggcaacaacaggacagttaatcattctggaacttctttgacatcttatattagtgagatccagatgccgcagatgatggatgactgacaatgtcgcgcggcatgaactatacggataaaaagataggatattcacagagtcatgtggacagcgaagttctcccagtaaaagcagtcataatgtagtattagcctggacagaacaatattcgatcagttccagagagaaaggaacgctgatcctttgaaaacccgtgtaattttatttcccttttcctcttttcccccctaagagaactgaaaattctttgttttatgataggcatctatatatacttattatcctctaaaaaaaaaaaaaaaa

SEQ ID NO: 40951 - protein, 106 aa, Zea mays
  misc_feature: Ceres CLONE 1434921
MVSKPVVLVFLLVVLIITSQFEWKQQLVNELESTARNQKHVSSREELVKDQIIFTQEKMIQRLNNFVQNLQQQLVQCRGNNRTVNHSGTSLTSYISEIQMPQMMDD

SEQ ID NO: 40952 - DNA, 674 bp, Zea mays
  misc_feature: Ceres CLONE 1434951-F
  misc_feature: Encodes the peptide sequence at SEQ ID NO. 40953
  misc_feature (564)..(564): n is a, c, t, g, unknown, or other
  misc_feature (565)..(565): n is a, c, t, g, unknown, or other
  misc_feature (575)..(575): n is a, c, t, g, unknown, or other
ggagctccccgcggtggcggccgctctatactagtggatcccccgggctgcaggaattcgcacgagaccattacctagaacatcctaatcgaaaaaagcccggagtttgtgggagaggaggatttgtcgagagggagggccgcgattcgttgctcttccttcctcctcctgctcgcctccggtgtgggggtgcgctgcggtgcggtgggcggaggggaggtcgagggatcaggagggcgaatcgagggggcgggaggagctagaaggagaggcggcggaaatggcggcgtggacctccgtcggcctggtggcggtggccgtgctggtcgtcggcatcgcaatgccggcctccgccgccgtgcagccgcccgcgcccgcgccctccagcgacggcacgtcgattgaccagggtatcgcatacgtgctgatgctggtggcccttgtgctcacctacctcatccatccgctggacgcctcctccccatacaggctctttctatctaatcaataattcgggttgcacctgtagaggtagctagcagctatgcgatgatgatgatttanntgtgtgtggntgtgtgtgtggggttcaattttttgatgcccgtcaaaagatttttatggcatttgttggaggggggcttgattccgccccccggggaggggttgggttt

SEQ ID NO: 40953 - protein, 76 aa, Zea mays
  misc_feature: Ceres CLONE 1434951-F
  misc_feature (8)..(61): Pfam Name: DUF1070 Pfam Description: Protein of unknown function (DUF1070)
MAAWTSVGLVAVAVLVVGIAMPASAAVQPPAPAPSSDGTSIDQGIAYVLMLVALVLTYLIHPLDASSPYRLFLSNQ

SEQ ID NO: 40954 - DNA, 658 bp, Zea mays
  misc_feature: Ceres CLONE 1434961-F
  misc_feature (490)..(490): n is a, c, t, g, unknown, or other
ctccccgcggtggcggccgctctagaactagtggatcccccgggctgcaggaattcgcacgagaccattacctagaacatcctaatcgaaaaatcacgagctgtcacaaactcagcacacaatcacactgacacgcacaccaccaccacggcaccggtagtgagaagcggagcgggaggacacgcggcgcggactgcgatggctcgtgcgctcggcgcttgcgtgctgctcgccgtcctgctcggtgccctggcgccggcggcggccgctgcgcgcccacgaagaccatggcagcggggccggcatactgcagccgagcggcgagtaccgcgggaggaaggtgggggccaggacggaggtgcactacgtggagggcgacggcgaggtgcaggagctcggccggttctccgtcaccgagtacaaccggcatctccgataaggtggcggcggcggcggcaggctcgagttcggcagggtggtggcggcgcanctgcaggtggtgtcggagctcaagtactacctccgcgtcgtggccgtggaggagggcggcgcgagagacagcggccagcgcgtgatcgactccgtcgtcgtcgtcgagccctgtctcgactcgcgcaccctgctcacgttcgcgccggcggccgacaagtgagcgcgg

SEQ ID NO: 40955 - DNA, 661 bp, Zea mays
  misc_feature: Ceres CLONE 1434982-F
  misc_feature: Encodes the peptide sequence at SEQ ID NO. 40956
acccgcggtggcggccgctctattctagtggatcccccgggctgcaggaattcgcacgagaccattacctagaacatcctaatcgaaaagtggatctcgtgttcctgcagcggatgctctgcacgctgtgttccggcagtggagactggagggcggcgcggcgatggaggacccgtgcaggaagggcgtctggtcagagtcgtccggaataaacgcgtccgtcgaatgcaactgcctcccctcaagggtgtgccgcatcacaagcctaaatgtgagtgggcacgggaacatctcggcgatcccgcgggagctattcaatttgacagaactggtctctctggatttaagtaataacaacttgagtggttcgatacccccggaagttattaatctttccaaactggaaacatgctaggcacttcaataataatcctctcagtggaggttttcctcatgaactgtcgcttttaaggaatctacggtccctgtggatgtttgataattacattgtagggccttttccggcatttattcagaacttaaccaatctcacagacttgcgaatatatgggacgaatcttcaaggacctattccaaaaaatttctctaatctgagcaatcttgaagtcctgatgcttggtgatcttgcgggcaaccattc

SEQ ID NO: 40956 - protein, 56 aa, Zea mays
  misc_feature: Ceres CLONE 1434982-F
  misc_feature: SWISSPROT Homolog: EC 2.7.11.1 Non-specific serine/threonine protein kinase
MFDNYIVGPFPAFIQNLTNLTDLRIYGTNLQGPIPKNFSNLSNLEVLMLGDLAGNH

SEQ ID NO: 40957 - DNA, 844 bp, Zea mays
  misc_feature: Ceres CLONE 1434992-R
ttgggtaccgggccccccctcgaggtcgacggtatcgataagcttttttttttttttttttgagataccatcaagaacgtcatttatacttaagaatgagaagatatagcttggtctgacagtgttgagcttgcaaacatatactttatgaccctcctagagggtcaagatgagaagatcgaagttcctacagatgatgaacctcatggccgatgagctacagtccagtaacgataacagatacacaataaactggatcaaagtgggcatacaaattccacggtgttgtatcggccaacacgtcagaagcgaaagaagacccattgtgttctgctcatcacatcagctgggacgaccggcacggagagactggaggcggtcgagccactggtcctcggggacgctgcccgcccacgccggcggcgcgccggggaactcgacgccgcgcatcgcgtccacgatccgcgccgcggagccctctggcagcagggcgctgcgtcgaggctcgtggtccgagaaagagcgtggccggttctcgccggggcggcgggctccgaatccatggaatttttcagaggctgcttgccgtttcgttttcttcgggaaagaagaaccagaggggtaattggggttatcagaatgcaaaaatccgtgggggggggcaagtgcgggtcccaaaaaaaggtggccgagattgggagcccccccagaaaccaatttcgcgcggaaaggcaaaacccgggaaaaccctggggaaattttcggagactcaaaaaattttggttcaggaaaaggaaacaggggcacgaagggccaggagaggcgcgtaatataaaagggttgg

SEQ ID NO: 40958 - DNA, 676 bp, Zea mays
  misc_feature: Ceres CLONE 1435012-F
  misc_feature: Encodes the peptide sequence at SEQ ID NO. 40959
  misc_feature (556)..(556): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (624)..(624): n is a, c, t, g, unknown, or other
  misc_feature (628)..(628): n is a, c, t, g, unknown, or other
tggagctccccgcggtggcggccgctctagaactagtggatcccccgggctgcaggaattcgcacgagaccattacctagaacatcctaatcgaaaaaggctcgttgttcctcttatccgcggaggaagaaccttggcccgacaccatgctcccaatggccgtccaccccaccaccacgccggccttgtccccgcgcgcccgcgtctcgccgcacaggcctcccatctcctccctggcggacccctcgtcctccccctgccatcgcatcgtcagtttcaaaagcaggaggctgccacttcgctctctccacatcgccgctgccgctgccgccggggcagaggaagaagaggcgcaactaggtggaagtgtgaacgcggtcgacgaggaggaagcggaagataatgtcgctggtgccccgataagaacagggaacccccccaaggcgggggggaccccacaaaaaaaaaccctctccctttggggggggggaaaaaaaaaaaaaagttggttcccctccccccccccccgtggggtttgttttgttttttatttgtngccaaaaaaaacctctttctattaggcgcacacaaccattttttttttatttttttttttnnnnnggngggnaaaaagagaaacaaaagggggggtgtgggtgtgttatattttataaaa

SEQ ID NO: 40959 - protein, 144 aa, Zea mays
  misc_feature: Ceres CLONE 1435012-F
  misc_feature (137)..(137): Xaa is any aa, unknown, or other
MLPMAVHPTTTPALSPRARVSPHRPPISSLADPSSSPCHRIVSFKSRRLPLRSLHIAAAAAAGAEEEEAQLGGSVNAVDEEEAEDNVAGAPIRTGNPPKAGGTPQKKTLSLWGGGKKKKSWFPSPPPRGVCFVFYLXPKKTSFY

SEQ ID NO: 40960 - DNA, 668 bp, Zea mays
  misc_feature: Ceres CLONE 1435015-F
cgcggtggcggccgctctagaactagtggatcccccgggctgcaggaattcgcacgagaccattacctagaacatcctaatcgaaaaaccaacagccaatccacacctcgcttgcgttgtcctcgccgcggcctcgccctgattcggttcccccgttcctcgcctctgtcatcgtctcctctgacccaaattgagccaagcaaagccgtggccgtgatccggtccatgcgcggagcgtggtagccggattctatcgccgtcgcctccccttcgtcgctattttccagtcgccgggatcagccgagttggatctcgaggcataaagcgttgcgggcgcccggcgaggatacgatgcctgcggtgctcgccgcattcgctacccttcgagccgccgctgccatcgcctccggggactcctccttcccctgttcccatcgtctcaagcatcgttttagtagtagtaattttagtagtagtaattgtcattaaccttttgcgttccctccgtcgcgcacgcttcctcgggttcggtcctcaacttcccaattttcggtttggggcctggttggggctcgcatcccaggccctaacttttgggttttggaggcttctctcccttgccaaaaagcttgggtgtctggggattccaacctgcagaatcggaaggg

SEQ ID NO: 40961 - DNA, 645 bp, Zea mays
  misc_feature: Ceres CLONE 1435034-F
  misc_feature: Encodes the peptide sequence at SEQ ID NO. 40962
  misc_feature (529)..(529): n is a, c, t, g, unknown, or other
  misc_feature (622)..(622): n is a, c, t, g, unknown, or other
  misc_feature (633)..(633): n is a, c, t, g, unknown, or other
tacccgcggtggcggccgctctataactagtggatcccccgggctgcaggaattcgcacgagaccattacctagaacatcctaatcgaaaaagccgcccgtcctctcggtctccgaccacgactgtgcgccttcctaagtaaccctagctcggcgccctccctccgcgacatccaagcccggcaatctcatcgtcgcgcttgcaccgttacgcagtgcgacctctgcgtcttcgaatccaggaaggtagagaggaggaggaggtttgtggcaggatttgaccagcccaatggttccatccgagatggggagcgtcgccaccgccgtcagcacgcctgctgcggacaagctgctccatgggcctatctctggcaagaagtgcaagaaaccaggcccgaggaagattcataaggctgagagggagaagcttaaacgagaccacctaaatgatctctttgttgagctgggtaatatgctagaagcagatagacagaacaatgggaaagcatgcatactgactgacactactncgatactaagagacctgctttgtcaagtagactctcttcgaaaagaacatagcgacctacaaaacgaatctcattatggtacaatggagaggnatgagatgcangatgaaaacggg

SEQ ID NO: 40962 - protein, 114 aa, Zea mays
  misc_feature: Ceres CLONE 1435034-F
  misc_feature (76)..(76): Xaa is any aa, unknown, or other
  misc_feature (107)..(107): Xaa is any aa, unknown, or other
  misc_feature (110)..(110): Xaa is any aa, unknown, or other
MGSVATAVSTPAADKLLHGPISGKKCKKPGPRKIHKAEREKLKRDHLNDLFVELGNMLEADRQNNGKACILTDTTXILRDLLCQVDSLRKEHSDLQNESHYGTMERXEMXDENG

SEQ ID NO: 40963 - DNA, 677 bp, Zea mays
  misc_feature: Ceres CLONE 1435040-F
  misc_feature: Encodes the peptide sequence at SEQ ID NO. 40964
cgcggtggcggccgctctagaactagtggatcccccgggctgcaggaattcgcacgagaccattacctagaacatcctaatcgaaaaaccaccgcagccgcagcacaatcgcctcgccttcccttccccaccagcccgtctctctcttctctctgactctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcacccggacgcgcgcccgccaacgtcgcctgcgccatcgccaagctcggcggatcctccgccttcgtaggcaagttcggcgacgacgaagttcgggacatgctgttgaacatcctgaagcaaaacaacgtgaacgcggagggggtgcctgttccacaagcccgcgccggaacgggcttggccttcttgaacctcaaacacgaaaggggaaccccaagtttcatgttccaaagggaaaccgcaacgcgggaaattgcttgtttaaagaagagggaaccttggacccgggggcccggggggcgggcccccccaggggtgtccccctaaccgg

SEQ ID NO: 40964 - protein, 154 aa, Zea mays
  misc_feature: Ceres CLONE 1435040-F
  misc_feature: SWISSPROT Homolog: EC 2.7.1.4 Fructokinase
MAPLGDGGAAAAAASNNLVVSFGEMLIDFVPDVAGLSLAESGGFVKAPGRAPANVACAIAKLGGSSAFVGKFGDDEVRDMLLNILKQNNVNAEGVPVPQARAGTGLAFLNLKHERGTPSFMFQRETATREIACLKKREPWTRGPGGRAPPGVSP

SEQ ID NO: 40965 - DNA, 542 bp, Zea mays
  misc_feature: Ceres CLONE 1435082-F
  misc_feature: Encodes the peptide sequence at SEQ ID NO. 40966
  misc_feature (332)..(332): n is a, c, t, g, unknown, or other
  misc_feature (499)..(499): n is a, c, t, g, unknown, or other
  misc_feature (501)..(501): n is a, c, t, g, unknown, or other
  misc_feature (502)..(502): n is a, c, t, g, unknown, or other
ctcacccgcggtggcggccgctctagaactagtggatcccccgggctgcaggaattcgcacgagaccattacctagaacatcctaatcgaaaaacgctcttcgtgcccgccgcctctcctccgtctctgcctctctccctctcccctcccgtctgacgcacatggcctccatcgccggatcttcggccctctccttcgccaggccccgtcaggcaatcaacacaaatttctctaacttttctccccggcgagggaagggcaaacaaattttcctccgcccggggaaccaaaggcccaaagaaaatttggtttttccggcgcccgccccccanagggggtccacaaaaaaaaggtttgtggaatttgaaaaaaactttgccccccccccccaggggggtgggggggggaaaatttttttgaaccccgccccaactccgagaaaggtgaagaaaagaagaatccccccggaaaccccctctttattttcgggggggggggngnnacacaaaaaaaacccccccccgttattaaaaccccccccc

SEQ ID NO: 40966 - protein, 127 aa, Zea mays
  misc_feature: Ceres CLONE 1435082-F
  misc_feature (57)..(57): Xaa is any aa, unknown, or other
  misc_feature (113)..(113): Xaa is any aa, unknown, or other
  misc_feature (114)..(114): Xaa is any aa, unknown, or other
MASIAGSSALSFARPRQAINTNFSNFSPRRGKGKQIFLRPGNQRPKENLVFPAPAPXRGSTKKRFVEFEKNFAPPPQGGGGGKIFLNPAPTPRKVKKRRIPPETPSLFSGGGXXHKKNPPPLLKPPP

SEQ ID NO: 40967 - DNA, 669 bp, Zea mays
  misc_feature: Ceres CLONE 1435100-F
  misc_feature: Translation starting site: 160
  misc_feature: Pfam Name: DUF143 Pfam Description: Domain of unknown function DUF143
acccgcggtggcggccgctctataactagtggatcccccgggctgcaggaattcgcacgagaccattacctagaacatcctaatcgaaaagattttggactagattcgtgcaaaacactgaaaaagaaaaggccatcgaaaacgccgccgccgcctctgatgctttccgccgtgcgatgtggtgcccttcgccggtggcgcccgccgccgcacctcctcccacgcatcctttcctcctcctttggtacatctcccgcgcgaccacaggtgggggcgctgctggagctcccggaggtggagaaggtactgcgcgacgtacgagcgggtggcgtgcgcgtattccccgtcggcgagagcggtctgcacggcggggcctgcgccgactacatggtcgtcgccacaggccgctccgattggcacgtccgtaacatcgcgcagggcgctcctctacaagataaagcaaaagcaaaagggctctgatagaatattgatgcccagtgtagaaagtcagcaagcgggaaaatggggtgtcatttgatctgggagcataatcatccatgcacttggagaagggcaagagagtattatgatttagagagcatttggtcaaaagaggtgtcccctaacacttccattcaggagttggagacctcgctggtgaaaaccctc

SEQ ID NO: 40968 - DNA, 736 bp, Zea mays
  misc_feature: Ceres CLONE 1435209-F
  misc_feature: Encodes the peptide sequence at SEQ ID NO. 40969
  misc_feature (320)..(320): n is a, c, t, g, unknown, or other
  misc_feature (339)..(339): n is a, c, t, g, unknown, or other
  misc_feature (344)..(344): n is a, c, t, g, unknown, or other
  misc_feature (362)..(362): n is a, c, t, g, unknown, or other
  misc_feature (387)..(387): n is a, c, t, g, unknown, or other
tccccgcggtggcggccgctctagaactagtggatcccccgggctgcaggaattcgcacgagaccattacctagaacatcctaatcgaaaaaagcagagtgtgtcgttgcggaggcaggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgggggagtgctctactgcangcctcacttcgaccagctngtcangaggacagggagcttggnacagagcttcgaaggaactccccanggttgtcagccagaaaagaacgttgggaatgaggatgctactaaagtctccagcgctttttgctgccccaaaaaaaaaatgtgtttgatgccacaaaaaaattctttccaactgaaaggggtcctggttataacccttttgtccccaaaagcttcttttaagggtcccaagagagggggccccaccaccccttttaaaatatttttgcccaaaggggagattttttttgtaacccccccccttttcctgtttaaaaggggaaagggggaattccccccccttttgaagggcccccccgaaaaaccccccccgtgtgggccctgggagggaagaaaaacaaaaatttttt

SEQ ID NO: 40969 - protein, 199 aa, Zea mays
  misc_feature: Ceres CLONE 1435209-F
  misc_feature (12)..(67): Pfam Name: LIM Pfam Description: LIM domain
  misc_feature (61)..(61): Xaa is any aa, unknown, or other
  misc_feature (69)..(69): Xaa is any aa, unknown, or other
  misc_feature (75)..(75): Xaa is any aa, unknown, or other
  misc_feature (83)..(83): Xaa is any aa, unknown, or other
MATSFQGTTTKCTACDKTVYLVDKLTADNRIYHKACFRCHHCKGTLKLANYNSFGGVLYCXPHFDQLVXRTGSLXQSFEGTPXGCQPEKNVGNEDATKVSSAFCCPKKKMCLMPQKNSFQLKGVLVITLLSPKASFKGPKRGGPTTPFKIFLPKGEIFFVTPPLFLFKRGKGEFPPLLKGPPEKPPPCGPWEGRKTKIF

SEQ ID NO: 40970 - DNA, 725 bp, Zea mays
  misc_feature: Ceres CLONE 1435210-F
  misc_feature: Pfam Name: Porin_3 Pfam Description: Eukaryotic porin
  misc_feature (344)..(344): n is a, c, t, g, unknown, or other
  misc_feature (403)..(403): n is a, c, t, g, unknown, or other
acccgcggtggcggccgctctagaactagtggatcccccgggctgcaggaattcgcacgagaccattacctagaacatcctaatcgaaaattatgctggagttaatgcaagcgttagtctgacagccaatcctgtagccaacctctctgctgcttttggcactaaggctctcgcagttggtgcagagatctcatttgattctgccactgggaacttcaccaaatacaatgctggattgatgttcactcatgaagaccttatcgcatcccttaatatgaacaacaagggagacaaccttactggagcttactacccacaggtgagcgaattgacaaacacagctngtggggcagagcttacccacagtttctcgaccaatgaaaacaccctcacctttggcggncagcacactcttggacccactaaccgtctttgaggcacgcatcaacaactttgggacaacccaggcccttgattcagcatgaatgaagccaaggtcccttggccccatcccgggtgaggccaaaaccaaaacccttaaaaaaacccccaggggcgaaatttcttgggccccttcaccccgaattaaataaacaaaaatttttttttttttaaaggcccaacaaaagaaggtttggggacaaaaccgggcccccgggggaaaaaaaaaaagttgggggtccccccgcacttctttggggccgccgcccccctttaattatcaa

SEQ ID NO: 40971 - DNA, 715 bp, Zea mays
  misc_feature: Ceres CLONE 1435214-F
  misc_feature: Encodes the peptide sequence at SEQ ID NO. 40972
aagctggagctccccgcggtggcggccgctctataactagtggatcccccgggctgcaggaattcgcacgagaccattacctagaacatcctaatcgaaaaaattcgtttatagcgagcacaccagcgaaccagagattcatcacagtggcgatggccccgagcgcgtctgatgctgttcctgagctaccaccagctccacaggccgacggaggtggggacgccgccgccgccgccgcgcagggaggcggctgcccccggtggcttctggaggaggatgagcgtgagcagcgtgctctcacccgctttgttgcaatgcccgccggaaggggaggcgacactgcacgagcgcgacgccggcgaggagatcaagtcatcggcgccggccgactctgataacgagctggaaagcaagttcgaggaggcgctgcgcctcagctgctggtcttcatgagcatccatccatcatggggaacggagagacgcgagcgtgccgctgagtcgaagcgacctctcctctaaacagccgtcctgtatctcttcctccgtgtatcagaatccatccttttgctttagatctctgtacatttgtaatcatcacatccgctcaagtatgccacctatattttaccttgtagcacaacaaaagaaccatggcttatcaatacccggctacctccgggggggggccgggaacccatttctcctattatggg

SEQ ID NO: 40972 - protein, 93 aa, Zea mays
  misc_feature: Ceres CLONE 1435214-F
MLFLSYHQLHRPTEVGTPPPPPRREAAAPGGFWRRMSVSSVLSPALLQCPPEGEATLHERDAGEEIKSSAPADSDNELESKFEEALRLSCWSS

SEQ ID NO: 40973 - DNA, 707 bp, Zea mays
  misc_feature: Ceres CLONE 1435215-F
  misc_feature: Encodes the peptide sequence at SEQ ID NO. 40974
  misc_feature (522)..(522): n is a, c, t, g, unknown, or other
ggagctccccgcggtggcggccgctctagaactagtggatcccccgggctgcaggaattcgcacgagaccattacctagaacatcctaatcgaaaaattatcaagaaaccatgagttctaggttagctgaaatctcccttattgtaatctgttcatctcctggcgtgagtctgtggcgttagtgtgatgccttctcctagctcatggcttccggttcgcaatccctaatcctgatctcacttaagcgctcgtgagctctctccagtggctaaagattgcagatttgagttatagtccaagaaacgggtggtggtccgccatggaggtgaggtccgagcaagggctgatggcggggagggatctattcggtatgccaaagagcccgccggcgccggtttcccgggcgccggcgtcccgcgccatgcagagcgtgcgcatggcgtacacctcggacggcaccgctgtgttcgcttcgatgagaatctccggcgcgacgccttcttaacaaccgcaggttgcaancccacgccgctagcatgtcccccggcaaaaaatctttggaaggcaaatggccccggaactttcccccaaacaagggggggagaccggtgccccaaaaaaaaaccccggcgcgcccaagaaaaaaaatgggccccaaaagggccccttggcccttgggaaatttggcgcccttttttccccgggcc

SEQ ID NO: 40974 - protein, 61 aa, Zea mays
  misc_feature: Ceres CLONE 1435215-F
MEVRSEQGLMAGRDLFGMPKSPPAPVSRAPASRAMQSVRMAYTSDGTAVFASMRISGATPS

SEQ ID NO: 40975 - DNA, 684 bp, Zea mays
  misc_feature: Ceres CLONE 1435217-F
  misc_feature: Encodes the peptide sequence at SEQ ID NO. 40976
ccccgcggtggcggccgctctagaactagtggatcccccgggctgcaggaattcgcacgagaccattacctagaacatcctaatcgaaaaatgactcccctctcgcgcgcgcggcggccggcggtcagccctcgcccgtcggagctggccgaggaggacgcgagcgcgctaaggtttctggaggaggcctgggtaccctggggcgcgcgatcttctcggtgggcaagtggatccggggcacggggcacgtcatggtaccgcctcggatccaccatccagatgcggcctccgcgtctacgcacatgtttcacggcatctgtacagtcatgaatatttttgagaaagagcccccgatccttaaacatgtgtttgtcgctcccagtgcgctgctcattggccatgttgatcttggacctggatctccattctggcccggatccctattgagaggagatgtcaacatccttcttgtcggatcagggtctaaccctcacttaccttcccttgtgcgtagcccaaattctatcattaggcggcaaggtcctcccatgcatccttgacagctacgtgacatgctgacacacagctgcactactcgcgagtaccgttatagccgaatcttttgtcgccatgggagctactctccttgcaggcctgatatgcgacaaccacttcctgattggg

SEQ ID NO: 40976 - protein, 85 aa, Zea mays
  misc_feature: Ceres CLONE 1435217-F
MFHGICTVMNIFEKEPPILKHVFVAPSALLIGHVDLGPGSPFWPGSLLRGDVNILLVGSGSNPHLPSLVRSPNSIIRRQGPPMHP

SEQ ID NO: 40977 - DNA, 872 bp, Zea mays
  misc_feature: Ceres CLONE 1435220-F
ggggcgggcccctcccgccttccttttttcgcgacccctttttataacgcccccaaacctggctctccccccggtgggggccgctttataatagtggatcccccgggctgcaggtatttcgcacgagaccattacctagaacatcttaatcgaaaaacaggtagctagcatacagaccaataatctcttcttgcgctgagtagcaccagctagcaactctttctctcctgggatagtggccgctcgctcctcctcctcctagccgcacctggtcccggcggtggtcggcgtggcggaggcgctgcggctattgtcgccgtcggtcgggacggcctcggccgcggtgagctgctgggaggtgacggcccctttcggcatcgtgccccgggagacgccgctggcagggtgcccccccatctttttcgggggcgcggcaccgggcgagggactctcgtaacggaaccgggaggcacctcgaccgccggaggcggaatgctaccccgccccccctgccccctggacgcgtgtagaggcaccggccatggcgggaggccccgtggtcgtttgcccccctaatttgcgcggaacggatcaaactcaaggcactggaactacgccccgtcgcggtgtggccccggtcaaccggcaaaccgtataagaacccgccgtgggagaagtccggcccgcggtggggacggcccaccgcgtagctggggccgggtaggctgcgccagctgggcgggcgggcgcgagataaggcggcggcggcgagagacgccgcgcgagcaggcgcgggcaccgcggcccctctgtaggagttacgcgtgggccggcggcggcgccttcgtaagagggcgccccgctcgtgaggg

SEQ ID NO: 40978 - DNA, 685 bp, Zea mays
  misc_feature: Ceres CLONE 1435224-F
  misc_feature: Encodes the peptide sequence at SEQ ID NO. 40979
  misc_feature (453)..(453): n is a, c, t, g, unknown, or other
  misc_feature (464)..(464): n is a, c, t, g, unknown, or other
  misc_feature (685)..(685): n is a, c, t, g, unknown, or other
gctcttaactagtggatcccccgggctgcaggaattcgcacgagaccattacctagaacatcctaatcgaaaaagaccattcggatgtgtctaatcagctttatgccaactacgcaattggaaaggatgttcaggccatgaaggcagtcgttggagaggaggcactctcgtctgaggatctgctttacttagagttccttgacaagtttgagaggaagtttgtgacacaaggagcatacgacacacggaacatcttccagtcactagatcttgcatggacattgcttcggatcttccctcgcgaacttctccaccgtatcccggcgaagaccttggaccagtactatagcagagatgcctcccactgaatcactgatcgttgatcagtgttccaatagtttggcaagtgttgaataaattgaacagattggcttcatggccttttccctgtanttatttgtagncaggtccaattcttttctggtgatgagcgcaagtttttcgtagatgactcgcggtcacgggcatatttggggatattgggccatcggggactatggttaaatttcagttatttgttttctttcccctccaaaccgggtagcaggagcattcgggacccagaggttccaacccactgggtggatgtcattttggaaagggaattaagaagggggaataaaan

SEQ ID NO: 40979 - protein, 76 aa, Zea mays
  misc_feature: Ceres CLONE 1435224-F
  misc_feature (1)..(76): Pfam Name: ATP-synt_ab_C Pfam Description: ATP synthase alpha/beta chain, C terminal domain
  misc_feature: SWISSPROT Homolog: EC 3.6.3.14 H(+)-transporting two-sector ATPase
MKAVVGEEALSSEDLLYLEFLDKFERKFVTQGAYDTRNIFQSLDLAWTLLRIFPRELLHRIPAKTLDQYYSRDASH

SEQ ID NO: 40980 - DNA, 793 bp, Zea mays
  misc_feature: Ceres CLONE 1435226-F
  misc_feature: Encodes the peptide sequence at SEQ ID NO. 40981
  misc_feature (40)..(40): n is a, c, t, g, unknown, or other
gtgcgcgcttccccctcccgcttattcccgaaacggcccngccccccctttttaatatggagctccacgcggtggcggccgctctataatagtggatcccccgggctgcaggaattcgcacgagaccattacctagaacatcctaatcgaaatcccttctctgcttgcttgctgctgcagtgctgcctccccctcgcccagcagcagggagcagccatgccaggggaccacggctccaagggcgacatctccttcgccggacgcttcacggccagcgccatctcagcatgcttcgcagagatatgtaccatcccgctcgacacggccaaggtcaggctccatctgcagaagaacgtcgtcgccgccgccgcctccggggacgccgcgccagcgcttcccaagtaccgcgccctggtcagaactgcccccaccatccctagggaggaaagggccgcaccgctctggaacggtatcttcccgggcctccaccgacggtgcatctacgggggacaccgcattggcctctacgatcctgtcaaatccttctacgtccgcaaaaaactattttgggaatttcccctttttccaataatatagccgcccggcttcacaagtgggggccttgcctattagtaatcgccaaaccctaccgtaccttggttaaggctcaggctcccagtggcccaagggcagagctatgtcaccccccatttgacccaccacccctaacactgtgcgatctatcggacatgccttatatccccagccatagggctcgaataagtggcaaggg

SEQ ID NO: 40981 - protein, 126 aa, Zea mays
  misc_feature: Ceres CLONE 1435226-F
  misc_feature (12)..(115): Pfam Name: Mito_carr Pfam Description: Mitochondrial carrier protein
MPGDHGSKGDISFAGRFTASAISACFAEICTIPLDTAKVRLHLQKNVVAAAASGDAAPALPKYRALVRTAPTIPREERAAPLWNGIFPGLHRRCIYGGHRIGLYDPVKSFYVRKKLFWEFPLFPII

SEQ ID NO: 40982 - DNA, 677 bp, Zea mays
  misc_feature: Ceres CLONE 1435227-F
  misc_feature: Encodes the peptide sequence at SEQ ID NO. 40983
ggagctccccgcggtggcggccgctctataactagtggatcccccgggctgcaggaattcgcacgagaccattacctagaacatcctaatcgaaaactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatggtctcagttgaagagtcttcagaagctgcaaagggcaagtcccaagtgaagttcagtgtgaagaaaaactcaagaatacagataaagagattaaagggcaaaggcaggaagaaagccaaaaatgcaaaaccacctgccaaggagaaagttgatgccatggtagcatgacggacaagactgcatacatccctttgtatgttttctcagagtttgcagcatggaccgacctcaccgaacactggcgcgtgaactgtctcttgcatcttctgcctgaatgctaaatagaagctacttaggcctggcgtt

SEQ ID NO: 40983 - protein, 129 aa, Zea mays
  misc_feature: Ceres CLONE 1435227-F
MAKYNVVQKNKRQCNQDRKRAAHGEPGTGKLKQRTAPVSMSGKRKKKLERRLNRKQKEAAMIKALENNMGDVDMVSVEESSEAAKGKSQVKFSVKKNSRIQIKRLKGKGRKKAKNAKPPAKEKVDAMVA

SEQ ID NO: 40984 - DNA, 507 bp, Zea mays
  misc_feature: Ceres CLONE 1435234-F
  misc_feature: Encodes the peptide sequence at SEQ ID NO. 40985
  misc_feature (294)..(294): n is a, c, t, g, unknown, or other
ggagctccccgcggtggcggccgctctagaactagtggatcccccgggctgcaggaattcgcacgagaccattacctagaacatcctaatcgaaaatgttaccgctacccagatgctcgagtcgatgatcaaatctcctaggccaacccgcgcagaggccactgacgttgcaaatgctgttcttgatggaactgactgtgtcatgctcagtggtgagagtgctgctggagcctaccccgaggtggctgtgaagatcatggctcgtatctgcatcgaggcagagtcttccctggnactacgagcatttttcaggccatgatcaaggtcccgcccccttccaatgacccctctggatcctcttgggccattttggtgggggaaattcccaaaaggcccaaggcccccctgaacccccctcttttacccccggggggcaccccggccaaatgggggccccaaaacccccccccggggtccccccccccccctttttgggggacccccgcc

SEQ ID NO: 40985 - protein, 68 aa, Zea mays
  misc_feature: Ceres CLONE 1435234-F
  misc_feature (1)..(66): Pfam Name: PK Pfam Description: Pyruvate kinase, barrel domain
  misc_feature: SWISSPROT Homolog: EC 2.7.1.40 Pyruvate kinase
  misc_feature (61)..(61): Xaa is any aa, unknown, or other
MLESMIKSPRPTRAEATDVANAVLDGTDCVMLSGESAAGAYPEVAVKIMARICIEAESSLXLRAFFRP

SEQ ID NO: 40986 - DNA, 704 bp, Zea mays
  misc_feature: Ceres CLONE 1435235-F
  misc_feature: Encodes the peptide sequence at SEQ ID NO. 40987
ggagctccccgcggtggcggccgctctataactagtggatcccccgggctgcaggaattcgcacgagaccattacctagaacatcctaatcgaaaactcttcttcctcgaccctcgtcgtggtgcggggcatctcgcaccccaccccctgtcctcccgctcaccggtgtgcgcgctttcctagggtttccgctgcccccgccgcccaccctgttctcctctcgtcagcggcgatggcgtcggcgtcggccccggtggcaggggcagtggccgggaatgatgacgagctcgccgatctggtgaggcgcctcgtggacgccctcgctcgctacgctgatcgcctgcccttcgacctcgatcgccagaagctccgttcacttactacacttgctgcaatctcgatcacacttctgtttgcctggaaaatgttgagaggtcctcaagagcaacctccgaggcctcgtaggagggttgccccatcgtcaagcaacaccagcactagatcgcgaccaggtgctttaccacaacagatgcttgttcatcagcagatttcagagcacacgaagcagtcaaccagctgttccaccagtaaatctgactcttgagcagcttgtcaagcataagctaaggggaagacaaaggtcccctgccgcctgcttggggggattttggaaaaaaacctccaaagagcttaaaaccttgtaa

SEQ ID NO: 40987 - protein, 123 aa, Zea mays
  misc_feature: Ceres CLONE 1435235-F
MASASAPVAGAVAGNDDELADLVRRLVDALARYADRLPFDLDRQKLRSLTTLAAISITLLFAWKMLRGPQEQPPRPRRRVAPSSSNTSTRSRPGALPQQMLVHQQISEHTKQSTSCSTSKSDS

SEQ ID NO: 40988 - DNA, 881 bp, Zea mays
  misc_feature: Ceres CLONE 1435240-F
  misc_feature: Encodes the peptide sequence at SEQ ID NO. 40989
  misc_feature (30)..(30): n is a, c, t, g, unknown, or other
  misc_feature (31)..(31): n is a, c, t, g, unknown, or other
tttttccccctcttcctcgcgcgttcgctnncctcgccaccgccccacctagtatatggagctccccgcggtggcggccgctctttaactagtggatcccccgggctgcaggttttcgcacgagaccattacctagaacatcctaatcgaaaaaaaaaaatccaattttctccgcgacgaaggagaggcatccctcccttccgcgtggtgtgctctctgttcctacgccgtttcctctcccgactctctcctcgccggcgacgccgcggagtaggtgccacagaaactgctcgaggcggaggcggaccctgcggctgctcatacatgggtgatcaccaggcgcgtgttggtgacctcgagaagaaggcggaaaagaagctctcgggctggggcctcttcggctccaagtacgaggacggcgccgacctcttcaacggggatgcgatctcgctatcgggtgggggacacacttgagcaggagctgcgtccggttcccggcaaagattggctagctgatcatcttgtaaggggagataggaagctcggaggcttgtgcttcgcgaccacagcccaatggccttccttatttgcgctatctacaccagattccatccttccgggtagggcgaagtgcagagcggcgtagagccgtgtcgtggttcacgtcctcgaattctaggtcagtgggcctacgtctcgcgcccattggccctggctatgatcccgctaccagggaacaattaggggcgcggccagatgatatagaacagggaatacccgccgtcaatgtgaagaggccccacctcaccgccacccttttgcgaagagcgcaccgcttcgcaccacccggtagatagctccgggcatggtggaaacgagcc

SEQ ID NO: 40989 - protein, 49 aa, Zea mays
  misc_feature: Ceres CLONE 1435240-F
MGDHQARVGDLEKKAEKKLSGWGLFGSKYEDGADLFNGDAISLSGGGHT

SEQ ID NO: 40990 - DNA, 716 bp, Zea mays
  misc_feature: Ceres CLONE 1435248-F
  misc_feature: Encodes the peptide sequence at SEQ ID NO. 40991
ggagctccccgcggtggcggccgctctagaactagtggatcccccgggctgcaggaattcgcacgagaccattacctagaacatcctaatcgaaaaacccaacgggcaagacgacgagggtttttgccgccgccatggcgatccctcgagcacgtctaactcgcctgctcctccacttcggcagccggggctccagattcctagcgcaacccttctctacctcttcctccgcacacggcctcttcccctctctgtggccaacgccgtccaccgccggcgcgtggcggcgcgcgttccacgatgggcggccgcgagggccgctgtggcggagcaagaagctgatcgggaaggaggccttatttgcgatccagggcctcgagcggttcaagggggacgaggagaagctagcggatttcgtgcggcggtatgtggccagactgctcaaggcggacaagcttgccgtgctcggcgagctggaacgccaggaggaggtcgatctggctgtcaagatgtttaggatcatacaaaaggaggactggtataaaccagatatttacatgtacaaagacttgattattgcattagccaaatgcaagaatatgggaggaagcaatgggtaatctggggggaacatgagagatgaggaccttggtttcctgactcacagacttatgccgaaagtaataagaggattcttggagatatggctcccccat

SEQ ID NO: 40991 - protein, 161 aa, Zea mays
  misc_feature: Ceres CLONE 1435248-F
MAIPRARLTRLLLHFGSRGSRFLAQPFSTSSSAHGLFPSLWPTPSTAGAWRRAFHDGRPRGPLWRSKKLIGKEALFAIQGLERFKGDEEKLADFVRRYVARLLKADKLAVLGELERQEEVDLAVKMFRIIQKEDWYKPDIYMYKDLIIALAKCKNMGGSNG

SEQ ID NO: 40992 - DNA, 735 bp, Zea mays
  misc_feature: Ceres CLONE 1435256-F
  misc_feature: Encodes the peptide sequence at SEQ ID NO. 40993
  misc_feature (426)..(426): n is a, c, t, g, unknown, or other
tccccgcggtggcggccgctctagaactagtggatcccccgggctgcaggaattcgcacgagaccattacctagaacatcctaatcgaaaaatatatccaacaaccagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgcccctacccgtgtcgcatcttcgtcgacatcgtcgcccagacgccccacatcgggctgataatatataagctagcccgctattccntttcccctgccccgaacttggaattaatttttttccgatgaaataccccgggcatgccaaaaaaaaaaaaaaaaaaaaaaagctttatcaatcccgttcaacctcaaggggggggcccggaaccccaatccccccaaaagggagccaatattacccgcctcccccgggcccccttttttaaaccccccggggatgggaaaaaccctgggggttaacccaaaataaaaaccccttggaaaaacaccccccctctttcccacgtgggggaaaaaaaaaagaaaacccccccaccaatttctccctttccaa

SEQ ID NO: 40993 - protein, 96 aa, Zea mays
  misc_feature: Ceres CLONE 1435256-F
  misc_feature (14)..(73): Pfam Name: potato_inhibit Pfam Description: Potato inhibitor I family
  misc_feature (84)..(84): Xaa is any aa, unknown, or other
MSSTECGGGGGGAKTSWPEVVGLSVEDAKKVILKDKPDADIVVLPVGSVVTADYRPYPCRIFVDIVAQTPHIGLIIYKLARYSXSPAPNLELIFFR

SEQ ID NO: 40994 - DNA, 690 bp, Zea mays
  misc_feature: Ceres CLONE 1435257-F
  misc_feature: Encodes the peptide sequence at SEQ ID NO. 40995
ggcggccgctctagaactagtggatcccccgggctgcaggaattcgcacgagaccattacctagaacatcctaaccgaaaacctaaaaccatcgccctgcccccgcctccgcctccgcctccgctgcatcccatggcggccgtgcagcgcctcctccgggcagtcgcccccggtggctcggcagcggcggcggtcaggaggcgcatgacgtcgcttgcgccggagcaggcgccgtctgcggccgccgggttcccattcgcggcggagcagagagcaaggcggccggtggcggcggagaggaacgtgcagtgggtgttcctgggctgccccggcgtgggcaagggcacctacgcgagccgcctgtcgcgcctcctcggcgtgccgcacatcgcgacgggggatcttgttcgcgacgagctcgcctccaccgggcacttgctacgcaggtgagagtgagcctcctctccgaactctacggtccagatcgccccactctgctctgcgctgatctggatttcatatttagttgggtggatcagcgacctggttgacctatttaactaaagattggagcccccctcgggtccaggggggatcaatccccgaaatggttaaaaaattgacaattgcggccgaaattgaccttaccgaaaacccttgggtggcgggcttaaaaaaaaaaaaaaaaaa

SEQ ID NO: 40995 - protein, 105 aa, Zea mays
  misc_feature: Ceres CLONE 1435257-F
  misc_feature: SWISSPROT Homolog: EC 2.7.4.3 Adenylate kinase
MAAVQRLLRAVAPGGSAAAAVRRRMTSLAPEQAPSAAAGFPFAAEQRARRPVAAERNVQWVFLGCPGVGKGTYASRLSRLLGVPHIATGDLVRDELASTGHLLRR

SEQ ID NO: 40996 - DNA, 697 bp, Zea mays
  misc_feature: Ceres CLONE 1435259-F
  misc_feature: Encodes the peptide sequence at SEQ ID NO. 40997
  misc_feature (697)..(697): n is a, c, t, g, unknown, or other
ggagctccccgcggtggcggccgctctagaactagtggatcccccgggctgcaggaattcgcacgagaccattacctagaacatcctaatcgaaaagttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaaatcgccgttttcccgtgcggatttcagagtcagagtcatcgatgcagaagaacgagttggatccggaaacgagtgagggaggatctgcttctattgatgggcggaggaggcattcgaatccttggaagaaaccgaagtttccaaaaaaaatcctgggggaatttctttgcccgccccaaacccggggtttgacccctttcagccgaaacaaaaacccaaaatcggaaaattaaacccccgccttcgaggtccaaaaaaccctaacccccagttcccccgggggtttttttttctttttcaacgggaaaagggatcccccgggaaaaacaaactcccgggggggttttctccccgggtttttccccaaaagagaagcgcgccgctttttttaaaaagcacacaaaatctcctcacn

SEQ ID NO: 40997 - protein, 63 aa, Zea mays
  misc_feature: Ceres CLONE 1435259-F
MQKNELDPETSEGGSASIDGRRRHSNPWKKPKFPKKILGEFLCPPQTRGLTPFSRNKNPKSEN

SEQ ID NO: 40998 - DNA, 740 bp, Zea mays
  misc_feature: Ceres CLONE 1435293-F
  misc_feature: Translation starting site: 214
  misc_feature: Pfam Name: SRP14 Pfam Description: Signal recognition particle 14kD protein
  misc_feature (318)..(318): n is a, c, t, g, unknown, or other
  misc_feature (337)..(337): n is a, c, t, g, unknown, or other
  misc_feature (362)..(362): n is a, c, t, g, unknown, or other
  misc_feature (393)..(393): n is a, c, t, g, unknown, or other
  misc_feature (501)..(501): n is a, c, t, g, unknown, or other
  misc_feature (512)..(512): n is a, c, t, g, unknown, or other
ggagctccccgcggtggcggccgctctatactagtggatcccccgggctgcaggaatttgcacgagaccattacctagaacatcctaatcgaaaaatattcgttctcccggcgtgctccgtctctcctctcagcgcgacgattacggtaacgccgtcgccgccctacggctcagatcttcgtcgtcatcttctccggcaacgagcacccaaagatggtggtccttcaaccagatcggttcctgagcgagctgacgagcatgtacgagcggagcacggagaagggctccgtctgggtcaccatgaagcgatcaactctncagggcaggcacagttgcngaagatggagaaataggggcaggangtagagcacaggtgcctcgtccgcgcctccnatggcaggaagaacatctccacctcggtttctctaaaggagtacacaaagtttcaagctccatacgcacagttcttaaggccaatatgcatgctctgaagaaaggggnagggaagcccnaaaaaaactggcaatgcttaaaaggcaattgaaccccccccaaaagacaaaaaagcctttttcaaaaaactttcgggtcccaggtaaggggcctccaaaaaaacgggggggttccccctttttgtttttaccccgcaaaaatataaagggggcgggaaatttcaaaaagcgggggttttaccaaaaccccgtcgggagaaaaaaaacccggaaaaaccccttttagag

SEQ ID NO: 40999 - DNA, 656 bp, Zea mays
  misc_feature: Ceres CLONE 1435301-F
  misc_feature: Encodes the peptide sequence at SEQ ID NO. 41000
aaagctggagctccccgcggtggcggccgctctagaactagtggatcccccgggctgcaggaattcgcacgagaccattacctagaacatcctaatcgaaaaaaagcacgagcccggttcgttctcgacctttcgtctcgctctcgcccgcccgaccccgcggagccctagcctagccttgcccccgaccgcggattccccctcggccgccgcgcgcccgcacccgcacccgcgatgatgaactgcgccggaggcggagaccccgtggaggacttcctgatctccggcgccgtcgacgacgaagatctagccatcttctgcgacggaggacttgggattgagggtgtcaatggagatgcttgtggatttgagcagtctaatttgggcaaaaggggtagagatgaaccatgttcatctggtctaaaatcaaagcttgtcgtgaaaaaatgagagggaccagctgaatgacaggttccctggaatttagttcgggtaatgaatcccgggaaaacaagccaaagttggaaaaagccccaaattttttggcgccccccccccccccttgtggggggccccccccttttggggggggggggggaaaaaaactttttaaaaaaaaccactggggggaaaggccccggcggggagagaaaaaa

SEQ ID NO: 41000 - protein, 71 aa, Zea mays
  misc_feature: Ceres CLONE 1435301-F
MMNCAGGGDPVEDFLISGAVDDEDLAIFCDGGLGIEGVNGDACGFEQSNLGKRGRDEPCSSGLKSKLVVKK

SEQ ID NO: 41001 - DNA, 694 bp, Zea mays
  misc_feature: Ceres CLONE 1435315-F
  misc_feature: Encodes the peptide sequence at SEQ ID NO. 41002
aaagctggagctccccgcggtggcggccgctctagaactagtggatcccccgggctgcaggaattcgcacgagaccattacctagaacatcctaatcgaaaaccgatccatctcgtctcttccgcgttgcttgcttgcttgctttagatgtgctgactgctgttggggtagggcagggggagaggagaggaggaggaggaggagctcgtagcggaatcagatcagatggtgcgtcgccagagcagagaaggccggggcctgggctggcctgcgtgctgcctcggcttcctgctcaagctgctcgcgttcctccaggccttcgccgccgtctccgccctcatctacgccgcttggatcctctcccgctgggcgcgccaccaccagctccacctccgcgaccttctaagcccggacctatggttcccgtcgctcgtcatggcggcggggatcttctactacctcctgctcctcgcgggttacttggcagctgagatcaacaccggatgctgcctctgcttctacaccatcccagccatggctatgatgctgctggaagctgctctcgccgcccatctggcgctcaaccagcactggatccaggaactgccagaggaccgcaccggcgagctccacaacttactctcctttatccacaataacctcgacctatgcaaatgggctgctcttgccatct

SEQ ID NO: 41002 - protein, 156 aa, Zea mays
  misc_feature: Ceres CLONE 1435315-F
MVRRQSREGRGLGWPACCLGFLLKLLAFLQAFAAVSALIYAAWILSRWARHHQLHLRDLLSPDLWFPSLVMAAGIFYYLLLLAGYLAAEINTGCCLCFYTIPAMAMMLLEAALAAHLALNQHWIQELPEDRTGELHNLLSFIHNNLDLCKWAALAI

SEQ ID NO: 41003 - DNA, 736 bp, Zea mays
  misc_feature: Ceres CLONE 1435316-F
  misc_feature (266)..(266): n is a, c, t, g, unknown, or other
  misc_feature (269)..(269): n is a, c, t, g, unknown, or other
  misc_feature (271)..(271): n is a, c, t, g, unknown, or other
  misc_feature (272)..(272): n is a, c, t, g, unknown, or other
  misc_feature (275)..(275): n is a, c, t, g, unknown, or other
  misc_feature (630)..(630): n is a, c, t, g, unknown, or other
  misc_feature (631)..(631): n is a, c, t, g, unknown, or other
ggagctccccgcggtggcggccgctctagaactagtggatcccccgggctgcaggaattcgcacgagaccattacctagaacatcctaatcgaaaaaactccaccgttcctccctcttcgttccctccgatcccgcccctataaatccagtcgcctcagccgccacagcgggccgcaagcacgtaaccacacagctcactgctgctcccgtcttcccgtgtcctgtcgtgctcccgtcgccgggggcggaagggttcgcgaggccngcngnncgntagggaatttctccgagtcccgcgatggcgagctggacttgcaggcgttcctggcccgcggatttgaccagaaccccgagtggttcatgaatcgggggggttggaacaacctaaatcccaatggcttcttttccggggcccccgccttcccggtttggggggccccctggacccgggggaacgtttaaacctttttccttttggaaaaaaaaccttttttcttggaaaaaaaagaacctttttttgaaaacccgggaaagaacaccctctttttttgggggaaaaaatgaaatggggcacccccttctttaaaaaagggcccccccggttgtccccggggcccggaaaaaaaaannccccccaaaaaaaaaaaaaaaaaagtttttttcaaacacacgggggggggggggggggggggggaaacaaataaaaaagaggggggggtttttataaaaaaaaaa

SEQ ID NO: 41004 - DNA, 669 bp, Zea mays
  misc_feature: Ceres CLONE 1435321-F
  misc_feature: Encodes the peptide sequence at SEQ ID NO. 41005
  misc_feature (529)..(529): n is a, c, t, g, unknown, or other
ggatcccccgggctgcaggaattcgcacgagaccattacctagaacatcctaatcgaaaaagattggagggaggcccctgcccaaggcaagagaaaccgcggcgcgcggagagggaggaagggcagacgcagacgggcgaacaagatgagggagatcatcagcatccacatcggccaggccgggatccaggtcggcaacgcctgctgggagctctactgcctcgagcacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgacgaggttcgcactggctcgtaccgccagctcttccacccagagcagctcatctcggggaagggagacgcagctaaacactttgcccgtggccactacacggtttgggaagggagattgtcgatctatgcctggaccgtgtgcgcaagcttgcagacnactgcactgggctgcaagaattcttgggtgttcatgctgttgggggtgggactgggtctggacttggttcactggtggtgaaccgcctttcgtttgattatggaaagagtcaaacttggttcccccattttcccttcccg

SEQ ID NO: 41005 - protein, 154 aa, Zea mays
  misc_feature: Ceres CLONE 1435321-F
MREIISIHIGQAGIQVGNACWELYCLEHGIEHDGTMPSDSSVGVAHDAFNTFFSETGSGKHVPRAIFVDLEPTVIDEVRTGSYRQLFHPEQLISGKGDAAKHFARGHYTVWEGRLSIYAWTVCASLQTTALGCKNSWVFMLLGVGLGLDLVHWW

SEQ ID NO: 41006 - DNA, 641 bp, Zea mays
  misc_feature: Ceres CLONE 1435326-F
  misc_feature: Encodes the peptide sequence at SEQ ID NO. 41007
  misc_feature (226)..(226): n is a, c, t, g, unknown, or other
tggagctccccgcggtggcggccgctctagaactagtggatcccccgggctgcaggaattcgcacgagaccattacctagaacatcctaatccgaaaagcaaggaagaggagcggaaggaggaggcgggggacaggaatacccaggagccgcagcaaggtcaaggcctcagcctctcactcgccaacggcagcgacagcggcaggtctggaaatgtgccgatgtcnaacccttcagctaatcccacacagcttacaattttctatgggggatcaatatgtggggatgatccgtgcccccgaaaaggctccgggaatcttgcttaaagttggggtttcaaaatttggggaacccccaaagggggggcccccccgtggttttcaccccccagggggaaaaaaaaaacgtgtgcccccccaaaaattttttcccccgtgggtaaacgggccccccccccggaaaaattttttttttacctgtggaaacaccccggggtttttccccccccccccaaaaaaaaggtttgggggggtccccccccctggggggggggctcctcccccccccctttttataaaaaaaaagggggggggggggggaaacaaactttccccccccccccccccctttttttgtgggggg

SEQ ID NO: 41007 - protein, 107 aa, Zea mays
  misc_feature: Ceres CLONE 1435326-F
GAPRGGGRSRTSGSPGLQEFARDHYLEHPNPKSKEEERKEEAGDRNTQEPQQGQGLSLSLANGSDSGRSGNVPMSNPSANPTQLTIFYGGSICGDDPCPRKGSGNLA

SEQ ID NO: 41008 - DNA, 725 bp, Zea mays
  misc_feature: Ceres CLONE 1435338-F
tggagctccccgcggtggcggccgctctagaactagtggatcccccgggctgcaggaattcgcacgagaccattacctagaacatcctaatcgaaaaactagggttctgtcgaacttccacgcattcctactactcctggctcccgcgacctgacgccgccactcctgacttcgccatccggcgatcaccagagacctagctccggcgtctctagcgatccccaaaacccactccgccgcatttctgccgacttggccggattggtcgcttattgagatgactacgccacttatagcaggacttgcagttgcagcaactgctcttgctggtcgatatggcgtccaagcttgggcagctttataggcaggcctatagttccaaggatgcgcaaattctatgaaggtggcttttcacctacaatgaacccgagggaagctgcattatcctttggggtccggaaaacttgccaccccaaaaaaggaaaaaaaccccccacaagggttttaaaccccccccctcccaaaggggggggaaaatcttccccttgccacaaaaaaaaagaagccaaagtttttttttcggaaaaaaaaaaggggggggggcccccctttagaaaaaaaaaaaacccccccccccctccaaaaaaaaaatttttgccccccccttttccccaaaaaaaaagcgcgcccccccttttttgttggtggagaaaaaaatagcagaa

SEQ ID NO: 41009 - DNA, 706 bp, Zea mays
  misc_feature: Ceres CLONE 1435344-F
  misc_feature: SWISSPROT Homolog: EC 3.1.2.15 Ubiquitin thiolesterase
  misc_feature (408)..(408): n is a, c, t, g, unknown, or other
  misc_feature (457)..(457): n is a, c, t, g, unknown, or other
tggagctccccgcggtggcggccgctctagaactagtggatcccccgggctgcaggaattcgcacgagaccattacctagaacatcctaatcgaaaaactatttttttttctcccgttcacctagcgtgaggcgtgcgctctcgtggcgactttggacaccgccggcgcctaccctctgtctcgtggcgacgagccgccgccgccgacctaagcgaggtctctgtgggactctttgctggtgacgagcaaccatcaggtccgcccctgatgagcaggcccaacactcgcaacaagagcaagaggccacgatctgatgaatccattaatccgtctgcggctgtttttcagagatatactcccgcggtgatatctcggaagacgatatctgccagctttacatggtgtgnaaaccgccttgccatggctgccatggcataactaggattcccaaaatgnttccggggggtgatcccggctgccaatggggtccgaaaacggccctctggcaaaaatgcggaaaaggttcgggttccggcccacatccctccaggggcccccccatttccctgaaaacccctggggaattaaaaacccgggggccccctgttttaaaaaaaaaattttgggccttttaaaaaagtttttccccccgcaggtttttttttttgagggggggtttttaaaaaaaccccttttgtctacacc

SEQ ID NO: 41010 - DNA, 718 bp, Zea mays
  misc_feature: Ceres CLONE 1435350-F
  misc_feature: Encodes the peptide sequence at SEQ ID NO. 41011
  misc_feature (566)..(566): n is a, c, t, g, unknown, or other
aagctggagctccccgcggtggcggccgctctataactagtggatcccccgggctgcaggaattcgcacgagaccattacctagaacatcctaatcgaaaagacagggtgactatttctagcgaggcaggaccgggaagatccggaagctgcgatgtcgaagcggctgctgtcgcggctgctcggcttgttccaatcgcggacgcaggtgggcgtcgacaaggtcggcaaccgctacttcacccgcgttgaggaggtcgacggcacaatgaaggagaggcgttgggtggagttcaagggcgcagaccaggactcgaccaccgttccagtcgagtggatttgctggctgaatggccaaaggaagaaagctccaacaccagaggaattggctgagctggaggcaagacgtgaacgtgtcaagcaaaacattcaacttctcaaaaagaaagaagaagaggaaagaaaaactggtatccaaccagtcaagaaaattggggaaggctgaatctccaaatctccaaaagtttcgtgaagcagcagttctcgggtgctcctccagatcagcanaaaggacctgaagataggcctaaggacaccactcattcagaagatgctacaacggacaatggaagggattctggacccacgggaaactggtgccccttttcaagccaggggacttgggcaccacccaccttaaatgcccacctggaactcta

SEQ ID NO: 41011 - protein, 116 aa, Zea mays
  misc_feature: Ceres CLONE 1435350-F
  misc_feature (16)..(109): Pfam Name: NDUFA12 Pfam Description: NADH ubiquinone oxidoreductase subunit NDUFA12
MSKRLLSRLLGLFQSRTQVGVDKVGNRYFTRVEEVDGTMKERRWVEFKGADQDSTTVPVEWICWLNGQRKKAPTPEELAELEARRERVKQNIQLLKKKEEEERKTGIQPVKKIGEG

SEQ ID NO: 41012 - DNA, 640 bp, Zea mays
  misc_feature: Ceres CLONE 1435356-F
  misc_feature: Encodes the peptide sequence at SEQ ID NO. 41013
aagctggagctccccgcggtggcggccgctctagaactagtggatcccccgggctgcaggaattcgcacgagaccattacctagaacatcctaatcgaaaaaagaccaagatagaccacccaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagt

SEQ ID NO: 41013 - protein, 154 aa, Zea mays
  misc_feature: Ceres CLONE 1435356-F
MAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMSE

SEQ ID NO: 41014 - DNA, 772 bp, Zea mays
  misc_feature: Ceres CLONE 1435364-F
  misc_feature: Encodes the peptide sequence at SEQ ID NO. 41015
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (472)..(472): n is a, c, t, g, unknown, or other
  misc_feature (507)..(507): n is a, c, t, g, unknown, or other
  misc_feature (567)..(567): n is a, c, t, g, unknown, or other
  misc_feature (608)..(608): n is a, c, t, g, unknown, or other
  misc_feature (676)..(676): n is a, c, t, g, unknown, or other
gggggggggggtttttccnntncggggcggcgcgcccccttnngggggnnnnnnaaaaagtggtgctccccgcggtggcggccgctctataactagtggatcccccgggctgcaggaattcgcacgagaccattacctagaacatcctaatcgaaaaaggcaactactccgtctcacgcctctcctgtcccctctcgccgctctcgccccgcctctgcctccgcctccgcctcctccatcgcacccagctttcctccccaccccaccgccactcctaccccgccgcgtcgtgtagtcgcggcggcggatatgcaagccgccgccgccttcaaccaggcagccttcaccgtccgctcgctgcatcgcgccccgaggcccctccatctagctgttgcggaggatgcttttgctgggataagagggggggcggtttaaccccccgggggtgcgggagcctctgtggcggggtctncgggtacgagtgcgggcgcactccaatatttcccnaacagccaccctgggatcccccagagccgtcttgttgggggagcaagatgcttcctgaanaaaccaggtccgggagtggcgcgggaacgtggcttgctctnaccaataccgcccccatctgcaaccaaagcacaaagacgcccgctcgtaagcgtgccttcctgaaccncgcagcgagagatggcagtaggcggaccgcggcaacgggtggccgacacggctgcgaattgcggatcctccagaaagagcgcattgcttgggaaaa

SEQ ID NO: 41015 - protein, 41 aa, Zea mays
  misc_feature: Ceres CLONE 1435364-F
MQAAAAFNQAAFTVRSLHRAPRPLHLAVAEDAFAGIRGGAV

SEQ ID NO: 41016 - DNA, 713 bp, Zea mays
  misc_feature: Ceres CLONE 1435374-F
  misc_feature (286)..(286): n is a, c, t, g, unknown, or other
  misc_feature (295)..(295): n is a, c, t, g, unknown, or other
  misc_feature (355)..(355): n is a, c, t, g, unknown, or other
  misc_feature (384)..(384): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggncagaatcangagagagatagcaggggggctagctagctgagctcgtgcgacgaaaaatggccggaattngcaggaacatggtggccgccgctcctggntgctcaacctcacatggacatcatcggcatcgggcttccgaagctgaaacctgaccactttcttacggggaaaacaactacccccgggtgggcgggaaaggggccaaattttcaatttccgggggtccccaaccggggcccgggggggggggcggggtcccaaatgggggggggggtgcccaaggtggcccttggggccccaaaaaatttgtgaaaaaaaacgcgggggtttctatatatcggggggaaaaagggggccccttttgggggtggggggagaaaaaaaaattctttttaaaaaaaaggggcgggtggttttttcccttctc

SEQ ID NO: 41017 - DNA, 629 bp, Zea mays
  misc_feature: Ceres CLONE 1435375-F
  misc_feature: Encodes the peptide sequence at SEQ ID NO. 41018
ggagctccccgcggtggcggccgctctagaactagtggatcccccgggctgcaggaattcgcacgagaccattacctagaacatcctaatcgaaaatacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcct

SEQ ID NO: 41018 - protein, 135 aa, Zea mays; identical to SEQ ID NO: 12387
  misc_feature: Ceres CLONE 1435375-F
  misc_feature (49)..(135): Pfam Name: Tubulin Pfam Description: Tubulin/FtsZ family, GTPase domain

SEQ ID NO: 41019 - DNA, 652 bp, Zea mays
  misc_feature: Ceres CLONE 1435376-F
  misc_feature: Encodes the peptide sequence at SEQ ID NO. 41020
  misc_feature (611)..(611): n is a, c, t, g, unknown, or other
  misc_feature (622)..(622): n is a, c, t, g, unknown, or other
ggagctccccgcggtggcggccgctctagaactagtggatcccccgggctgcaggaattcgcacgagaccattacctagaacatcctaatcgaaaagattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgatggtggcggaggcccgggtgtgcatgggcaagagccagcaccactcgttcccctgcatctccgaccgcctctgcagcaacgagtgcgtcaaggaggacggcgggtggaccgccggctactgccacctccgctactgcaggtgccagaaggcgtgctaagcaaagctcttgaaacacccttggcttgccagaactgaactgtggtagtactaagtaacacccttggctagctgtgcacaacctacgtaccgtgcatgcatgtaatgtggtgtcatgtaacgtgacagcaataaatattaataacaataataacacggcatgtagccctttgcatgcttctagcagcagactgtgncgatcccaccnggtcagcgaaccgtttccgattttccatcc

SEQ ID NO: 41020 - protein, 82 aa, Zea mays
  misc_feature: Ceres CLONE 1435376-F
  misc_feature (36)..(82): Pfam Name: Gamma-thionin Pfam Description: Gamma-thionin family
MELIKSRATVCALLLALLLLSHYDGGTTTTMVAEARVCMGKSQHHSFPCISDRLCSNECVKEDGGWTAGYCHLRYCRCQKAC

SEQ ID NO: 41021 - DNA, 629 bp, Zea mays
  misc_feature: Ceres CLONE 1435380-F
  misc_feature: Encodes the peptide sequence at SEQ ID NO. 41022
  misc_feature (523)..(523): n is a, c, t, g, unknown, or other
  misc_feature (525)..(525): n is a, c, t, g, unknown, or other
gcggtggcggccgctctagaactagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccgccccccgatggagctgttcgcgcgcgccaaggtggtgcggctcaagagccaccacgacaagttcctgtacgcggacgaggacgaggcgcacgtgacgcaggagcgggacgggtcgtcggcgaacgcgcggtgggccgtggagccggcgccgcacaacccgggcgccatccgcctgcggagccggtacggccactacctcaccgcctccggggaagcgttcctgctggggatgacgggcccgaaggtgacgcaaacngngcccgccgcgccccgccccggcaaaggcgtcgtggactgggagcccgtgcggggaagccttcaggcgcgcctccgcaccagggcggggcacttcctccgcggca

SEQ ID NO: 41022 - protein, 118 aa, Zea mays
  misc_feature: Ceres CLONE 1435380-F
  misc_feature (1)..(118): Pfam Name: DUF569 Pfam Description: Protein of unknown function (DUF569)
  misc_feature (84)..(84): Xaa is any aa, unknown, or other
MELFARAKVVRLKSHHDKFLYADEDEAHVTQERDGSSANARWAVEPAPHNPGAIRLRSRYGHYLTASGEAFLLGMTGPKVTQTXPAAPRPGKGVVDWEPVRGSLQARLRTRAGHFLRG

SEQ ID NO: 41023 - DNA, 646 bp, Zea mays
  misc_feature: Ceres CLONE 1435381-F
  misc_feature: Encodes the peptide sequence at SEQ ID NO. 41024
aaagctggagctccccgcggtggcggccgctctagaactagtggatcccccgggctgcaggaattcgcacgagaccattacctagaacatcctaatcgaaaatccatcttatcatccgccgccaatgctgcgccgcaacccaacccgcatcgagctcacctcctccgaccgcgacgagctcgaagaccacctccgcgccgccgcggcgagctccaccaaggatccttccggttacaccactccgtctccagtccttggcccgcagacctccaatcccctgctccaattcctccacccgaagcccggcgccgcgccatccaagtcccaacgcatcggcatcggcctctccaccccgccggctccggccccgaacccgcgaccaccccatccacctcatggaggttgagatcaagctccgcctccccgacgccgccgcgcaccgccgcctgtccgcgttcctcgcgccccgcctccgccgcacccacgcccagcggaacctcttcttcgacgacgccgcgcgcacgctcggagccgccaccgccgcgctccgcgtccgcctctacgacgggcccgacgaccgcggcccctcgcgcgccgtcctcgcgctcaagcgccgcccgcggatcgaggccggcgtcagccgcgt

SEQ ID NO: 41024 - protein, 83 aa, Zea mays
  misc_feature: Ceres CLONE 1435381-F
MEVEIKLRLPDAAAHRRLSAFLAPRLRRTHAQRNLFFDDAARTLGAATAALRVRLYDGPDDRGPSRAVLALKRRPRIEAGVSR

SEQ ID NO: 41025 - DNA, 647 bp, Zea mays
  misc_feature: Ceres CLONE 1435392-F
  misc_feature: Encodes the peptide sequence at SEQ ID NO. 41026
ggagctccccgcggtggcggccgctctagaactagtggatcccccgggctgcaggaattcgcacgagaccattacctagaacatcctaatcgaaaacacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagacagccgatcgaccgagacatagcacgcgatggcgaggtcttccaagatgatggtggcggcagctctgctggccttggccctggccgtgtcgaccgccgaggcgaggaacatcaagaccacgacgacggaaaaaaaggacgacgcggtggtgcagccgcagaccttcccgcccttcgaccgcctcggcggcggcgcgtccccggcgttcggcggcctcccccgcggcagcattcctggcagcagcattcccgggttcagcatgcccggcagcggcagcagcctacccggggttcagcttggccggcagcggcagcatgcccctctttcggcgcggcttccccggcttcaacggcttccgggggatgccccggttcgccaacggccggttccgtcccgaacacgccaaa

SEQ ID NO: 41026 - protein, 126 aa, Zea mays
  misc_feature: Ceres CLONE 1435392-F
MARSSKMMVAAALLALALAVSTAEARNIKTTTTEKKDDAVVQPQTFPPFDRLGGGASPAFGGLPRGSIPGSSIPGFSMPGSGSSLPGVQLGRQRQHAPLSARLPRLQRLPGDAPVRQRPVPSRTRQ

SEQ ID NO: 41027 - DNA, 689 bp, Zea mays
  misc_feature: Ceres CLONE 1435397-F
  misc_feature: Encodes the peptide sequence at SEQ ID NO. 41028
  misc_feature (182)..(182): n is a, c, t, g, unknown, or other
  misc_feature (183)..(183): n is a, c, t, g, unknown, or other
  misc_feature (349)..(349): n is a, c, t, g, unknown, or other
  misc_feature (363)..(363): n is a, c, t, g, unknown, or other
  misc_feature (364)..(364): n is a, c, t, g, unknown, or other
  misc_feature (450)..(450): n is a, c, t, g, unknown, or other
  misc_feature (483)..(483): n is a, c, t, g, unknown, or other
  misc_feature (504)..(504): n is a, c, t, g, unknown, or other
  misc_feature (506)..(506): n is a, c, t, g, unknown, or other
  misc_feature (507)..(507): n is a, c, t, g, unknown, or other
  misc_feature (509)..(509): n is a, c, t, g, unknown, or other
  misc_feature (511)..(511): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (578)..(578): n is a, c, t, g, unknown, or other
aaactggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctnngctagcctaccatggggctgatcaccaccggggtgcgacgggaggtggcgggggctacggcgacctccagcgcggggcggctgccggcgagcgcagcagcagcagaacagggcgccatgatgacggcgctcaagggccgcgacggccgcgaacccttcggcggggntcgaatggctgggnntgctgtccccggggcttgaaatcccctttggcccggggcacccgttggaatcgcgggcttccacggggggggcccaccccccccgntggcttgggtggatcctttcaaacccccggggncccttgggggtggccccgggngnncncncccccgcccccccccccaattttttttnnnnnccgcctgggggccttccaattggcccggcccgggnttttcgtcacccttccggggggcccttcgggggtcccttgcccctttcccggtgtcccccctgaatggaccaaattccctgaaggggaaaaccccccgccgggggccccaa

SEQ ID NO: 41028 - protein, 62 aa, Zea mays
  misc_feature: Ceres CLONE 1435397-F
  misc_feature (52)..(52): Xaa is any aa, unknown, or other
  misc_feature (57)..(57): Xaa is any aa, unknown, or other
MGLITTGVRREVAGATATSSAGRLPASAAAAEQGAMMTALKGRDGREPFGGXRMAGXAVPGA

SEQ ID NO: 41029 - DNA, 649 bp, Zea mays
  misc_feature: Ceres CLONE 1435399-F
ccccgcggtggcggccgctctagaactagtggatcccccgggctgcaggaattcgcacgagaccattacctagaacatcctaatcgaaaaaaccaagaaacgattgctcttccttgaatcatgtcttctgccgtgctcgggcgctgagcccatttcttccatctccaatctccccacgtgcaccgtgttgagcaccacacaacctgttccccatggaggctgaagaggttgatgtctgtctgctacgactgcggaagacgaaacgcgcctgctccccctgtaggagcaggcggagcacggttgccgtttgccctagctaatacctctgcctctaccatccgtgcctccgctaccctccatctcgctcgcgtcctccgcggccgtctctacctcctcaacaacgcctccgcgcgctccgaacttgcctcagaacagaggacgctctacgagcacgtgggcactagtcgtcatggattgacagcctctcaatctgttctatgactataaaggattacttacataacatgttcctgggatcacacgtattgcccgactagaacttcgtctgttccactctcattgagaatgatcagactgtgacatagcctacccaatcctcctacatcacaaaccctttaacacactgcac

SEQ ID NO: 41030 - DNA, 641 bp, Zea mays
  misc_feature: Ceres CLONE 1435401-F
  misc_feature: Encodes the peptide sequence at SEQ ID NO. 41031
  misc_feature (518)..(518): n is a, c, t, g, unknown, or other
  misc_feature (569)..(569): n is a, c, t, g, unknown, or other
  misc_feature (611)..(611): n is a, c, t, g, unknown, or other
  misc_feature (612)..(612): n is a, c, t, g, unknown, or other
  misc_feature (622)..(622): n is a, c, t, g, unknown, or other
  misc_feature (628)..(628): n is a, c, t, g, unknown, or other
tggagctccccgcggtggcggccgctctagaactagtggatcccccgggctgcaggaattcgcacgagaccattacctagaacatcctaatcgaaaaacccccacgccccaccccaccaaacaatggcgccggcggcgacttccacagcctctgcgccctcctccttccactccactggtaggcatagggccagggtcggggcccggccatcgctcgtctctctccgcgtcagagcagccaatcccaacgttaccgccgatcccgcaccggccttccagtccgtcacggccttcgcgccagccaccgtcgccaacctcggcccgggcttcgacttcctcggatgcgccgtcgccgacgcctccctctccctgggtgacaccgtcaccgcaaccctggacccgtcactcccgcccgccaccgtctccatcgcctccatcacatccccgtcccgccccaacctcgccgagcgcctctctagggacccgctccgaaactgcgcgggcgtcgccgccatcgncgcgctccgcggcctcggggtccgcttccacgccgtgttcatccacctcancaaaggcctgccgctcggctcggggctcggctccctcgcggnnctcgcgccgncgacgncaaagccgtcgac

SEQ ID NO: 41031 - protein, 172 aa, Zea mays
  misc_feature: Ceres CLONE 1435401-F
  misc_feature: SWISSPROT Homolog: EC 2.7.1.39 Homoserine kinase
  misc_feature (132)..(132): Xaa is any aa, unknown, or other
  misc_feature (149)..(149): Xaa is any aa, unknown, or other
  misc_feature (163)..(163): Xaa is any aa, unknown, or other
  misc_feature (167)..(167): Xaa is any aa, unknown, or other
  misc_feature (169)..(169): Xaa is any aa, unknown, or other
MAPAATSTASAPSSFHSTGRHRARVGARPSLVSLRVRAANPNVTADPAPAFQSVTAFAPATVANLGPGFDFLGCAVADASLSLGDTVTATLDPSLPPATVSIASITSPSRPNLAERLSRDPLRNCAGVAAIXALRGLGVRFHAVFIHLXKGLPLGSGLGSLAXLAPXTXKPS

SEQ ID NO: 41032 - DNA, 647 bp, Zea mays
  misc_feature: Ceres CLONE 1435413-F
tggagctccccgcggtggcggccgctctagaactagtggatcccccgggctgcaggaattcgcacgagaccattacctagaacatcctaatcgaaaaattggggcaggatcccgcgatggctcccagctcggtggcgtggaacccgtccgtggcgcccgcgaggccgaggtcgagctcggtgagcgccgcggctgctgccgggtgcgctgcgagcgccggcccgatgtcctccgtccagcagtagaactcggagaggtcgagcgccctgagcgctgggcagtccccgaggagcggctcgagatccgcgccggcgtcgaggcccggcgggcgctggtgccagcgcacgagcttgacgctgcggaggcgggacctccagtgcggggtgaggctgacgagcgtggtggggtcgcggcagtagacggcgagcgaggacacggcggggaagcagtaggcgaggcgcgccgcgaccagctcgttctgctccgcgacctgctgcggcgtcacggacggcgcgacggcgtcggccgacggcgccgcggaggagaggaacgggtggccccacggggacgccagcgagaggtcgagccgctccagcgccgggaagcagaacgccggcctgaggaagaggaacgcgggcgaccgtggg

SEQ ID NO: 41033 - DNA, 655 bp, Zea mays
  misc_feature: Ceres CLONE 1435414-F
  misc_feature: Encodes the peptide sequence at SEQ ID NO. 41034
ggagctccccgcggtggcggccgctctagaactagtggatcccccgggctgcaggaattcgcacgagaccattacctagaacatcctaatcgaaaaatagcgacacgatcctctcatcggcttcatttcgatggagtgcaaccctcctttggcaccttgtagagtcgaagtccaactagatgagtgccgcggctgctgcacgatgcacttggagcaacggtccgatgtcctcctcctggcaggagatcttccagatctccagcgtcctgatcgctggacaatccacgaggagcgcctagagatccgcgcccgaatcgaagcccgacgagcactggtgccagcgcacgaacttgacgctgcggaggcacggacatcactccccggggaagactgactacgatatcgagtgcccggagctacaccgccaagctgacccgggcgaggacggcgaaggcgaggtggacccctaccacttccttttcctccagggactagttgccggcccagggactgcccccaccccaagggccaaccgtggccaaaaccaaaaaggactggtgggcccccccgcgaccccaaatggaaggtcaaaccgttacaagacctggaaacccaaaaccccggcctgaggaaaaaaaacccggagaaaccctgg

SEQ ID NO: 41034 - protein, 87 aa, Zea mays
  misc_feature: Ceres CLONE 1435414-F
MECNPPLAPCRVEVQLDECRGCCTMHLEQRSDVLLLAGDLPDLQRPDRWTIHEERLEIRARIEARRALVPAHELDAAEARTSLPGED

SEQ ID NO: 41035 - DNA, 654 bp, Zea mays
  misc_feature: Ceres CLONE 1435420-F
  misc_feature: Encodes the peptide sequence at SEQ ID NO. 41036
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (411)..(411): n is a, c, t, g, unknown, or other
  misc_feature (416)..(416): n is a, c, t, g, unknown, or other
  misc_feature (418)..(418): n is a, c, t, g, unknown, or other
  misc_feature (419)..(419): n is a, c, t, g, unknown, or other
tggagctccccgcggtggcggccgctctagaactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtgggggacgaaggnnnncccccaaaagaagaggaggnnnnaagncaccncnngaaaccaggctaggcgcagcagcatgggcgccgggatcagggtcctggcggcgctcttggcggcgctcgcggcagccaccgccggcgtgacggcgcagctgcggcaggactactacgcggcggtgtgcccggacctggagagcatcgtgcgcgccgcggtgtccaagaaggtgcaggcgcagcccgtcgccgtgggcgccaccatccgcctcttcttccacgactgcttcgtcga

SEQ ID NO: 41036 - protein, 70 aa, Zea mays
  misc_feature: Ceres CLONE 1435420-F
  misc_feature: SWISSPROT Homolog: EC 1.11.1.7 Peroxidase
MGAGIRVLAALLAALAAATAGVTAQLRQDYYAAVCPDLESIVRAAVSKKVQAQPVAVGATIRLFFHDCFV

SEQ ID NO: 41037 - DNA, 645 bp, Zea mays
  misc_feature: Ceres CLONE 1435426-F
  misc_feature: Encodes the peptide sequence at SEQ ID NO. 41038
  misc_feature (542)..(542): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaaacagtaactagcagctagcacatcaaacaagtggcgacagacaaagatttgtgagggtgatccgcgctgagaagagatggctaagatcgccgcggcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcggcggcggcggcgttggcccgttccggtggggcaccgggctccggatgcggtgctgccagcagctccaggacgtgagccgcgagtgccgctgcgccgccatccggagcatggtcaggggctacgaggaggccatgccgccgctggagaaaggctggtggcgcatgggggcggcagcacccnncccccgccgcagggagaaggaggaggacaggggggctactactacccctgcagccggcccagagagggatacggctacgggtcagggtgccagcggcagatg

SEQ ID NO: 41038 - protein, 155 aa, Zea mays
  misc_feature: Ceres CLONE 1435426-F
  misc_feature (122)..(122): Xaa is any aa, unknown, or other
MAKIAAAAAAALCFAALVAVAVCQGEVERQRLRDLQCWQEVQESPLDACRQVLDRQLTGGGGGGGVGPFRWGTGLRMRCCQQLQDVSRECRCAAIRSMVRGYEEAMPPLEKGWWRMGAAAPXPRRREKEEDRGATTTPAAGPERDTATGQGASGR

SEQ ID NO: 41039 - DNA, 608 bp, Zea mays
  misc_feature: Ceres CLONE 1435437-F
  misc_feature: Encodes the peptide sequence at SEQ ID NO. 41040
  misc_feature (369)..(369): n is a, c, t, g, unknown, or other
  misc_feature (504)..(504): n is a, c, t, g, unknown, or other
  misc_feature (514)..(514): n is a, c, t, g, unknown, or other
  misc_feature (522)..(522): n is a, c, t, g, unknown, or other
  misc_feature (534)..(534): n is a, c, t, g, unknown, or other
  misc_feature (535)..(535): n is a, c, t, g, unknown, or other
  misc_feature (540)..(540): n is a, c, t, g, unknown, or other
  misc_feature (541)..(541): n is a, c, t, g, unknown, or other
  misc_feature (559)..(559): n is a, c, t, g, unknown, or other
  misc_feature (562)..(562): n is a, c, t, g, unknown, or other
tggagctccccgcggtggcggccgctctagaactagtggatcccccgggctgcaggaattcgcacgagattattacctagaacatcctaatcgaaaagaggaggaaaagcacgcgagagcttgtcggagggctctctgtctctgtgataaaccgatacgcagaggaagctgcggagaggtgtccctgctctgccggtgagctgcggccagcgggtgaagagaagtggaccggacgggggacgaaggagagagagaagaagaaaaaggcgccgcgggggccatggctggacacgcgccggcgagggacaagaccaccaccggcttcgccgctacgtgcagcctgctgagccagtttctcaaggaaagaanggcggcctgcagggcctcggcggcctcgccatggcgcccgcgccggcagctggagcaggggctttccggccgccgacccacatgacttgctgtccgcgctcgacgcggccaaggccacccgtcgggagccagaanggcatggccnacgcaccngcgggatccagnnaggcnnctgggggaggaggcccancanctgaccatcttctacggggggaaaggtggtctccttcaaccggtcc

SEQ ID NO: 41040 - protein, 57 aa, Zea mays
  misc_feature: Ceres CLONE 1435437-F
  misc_feature (30)..(30): Xaa is any aa, unknown, or other
MAGHAPARDKTTTGFAATCSLLSQFLKERXAACRASAASPWRPRRQLEQGLSGRRPT

SEQ ID NO: 41041 - DNA, 638 bp, Zea mays
  misc_feature: Ceres CLONE 1435452-F
  misc_feature (296)..(296): n is a, c, t, g, unknown, or other
caccgcggtggcggccgctctagaactagtggatcccccgggctgcaggaattcgcacgagaccattacctagaacatcctaatcgaaaaattttcatttccccacctctctaaaaccctcgctcttgcccgctgttttacacctaaaagaaaggtcctcgccgtcgagccgccggctcccatctcccgcgccgtcgccgacgaggacacaccagacgcctcgctgatggccttggctcgcctcggacggtctcttgccggccgccctccacgttctatctaccgtccaccggcgnccacagactaccatgccctccgtttcccgacccttcgctcccacccaaacaggcgtatgcgtaccgaggtttttcaagcctggacgtacaatgccccgcagcatgtatgggccccaatctccaggggccctttcccagcccacattggggaagggtcccggatcccccaaacccattaaaatcctggttggacccgatttcaccccccccccccctccaagggggccttttttggaaccccggaaagggtgggccctaaaaggttcccccaaaagaaaaccccggggtttcccaaaattaacccggtaaacgccccccggggaaacccttttcccctttttg

SEQ ID NO: 41042 - DNA, 677 bp, Zea mays
  misc_feature: Ceres CLONE 1435465-F
  misc_feature (620)..(620): n is a, c, t, g, unknown, or other
aaagctggagctccccgcggtggcggccgctctagaactagtggatcccccgggctgcaggaattcgcacgagaccattacctagaacatcctaatcgaaaaagaaatccatcccgatcctatcgtccccaatttcttctgctccacctaaatagatccgtagccgtagcctaggcgcgcacattgcagaaagatcgagcgaaaggtcggcagcaggcgcatagatgcaggggtgagggcacgggcggcagcgcttgacgggcgacgagtaaaccctaacgctttgattgcgggcggcgtcgtctgagccagtcccgagtcgatacgctgtcatgcctgtcaatcctcctccgccacctcctgggtcgtcgtctttggctccggggggggggcagctacttcccgctcccctttcacctgcagcagcacccagccgccgccggcccgaaggggccccccctttggggggcgaggagcttttcacagtattcagcaacaggtggattaggggccttcaggtctttccgggggggaggcggaaaacaaaagcccccggagggggtgggggggggggggaggggggcgccttgggggggggggggttgtttaggcccttgagncgccccaagaggcaggggtcgccgatgcccctctacagaggagggacccctcccccc

SEQ ID NO: 41043 - DNA, 601 bp, Zea mays
  misc_feature: Ceres CLONE 1435479-F
  misc_feature: Encodes the peptide sequence at SEQ ID NO. 41044
  misc_feature (544)..(544): n is a, c, t, g, unknown, or other
  misc_feature (568)..(568): n is a, c, t, g, unknown, or other
aagctggagctccccgcggtggcggccgctctagaactagtggatcccccgggctgcaggaattcgcacgagaccattacctagaacatcctaatcgaaaaaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccgggcgtggccggcaacggcgcgacgttctacttccctgggtgtcgccatccntgcccggcgtggtgggcgcccgcntcaaacctggcgggcgtgcaccacgtgcgcgcc

SEQ ID NO: 41044 - protein, 78 aa, Zea mays
  misc_feature: Ceres CLONE 1435479-F
  misc_feature (60)..(60): Xaa is any aa, unknown, or other
  misc_feature (68)..(68): Xaa is any aa, unknown, or other
MAGIGRNMVAPLLVLNLIMYIIVIGFASWNLNHFINGQTNYPGRGRQRRDVLLPWVSPSXPGVVGARXKPGGRAPRAR

SEQ ID NO: 41045 - DNA, 652 bp, Zea mays
  misc_feature: Ceres CLONE 1435488-F
  misc_feature: Encodes the peptide sequence at SEQ ID NO. 41046
aagctggagctccccgcggtggcggccgctctagaactagtggatcccccgggctgcaggaattcgcacgagaccattcctagaacatcctaatcaaaaaattatattagtttggtagtttagtgacgctgaggcctcgtccccgatcagacttgttcggcctcttcgacggcgtgcccgtctccccgggctcattcgccatgcattcctcagcctccgcgagaggaggacgagggctcctcttgccggcggcggttgtggtgctactgttgggtgcagtggcgccagcggcgggttgctatccgcgcgtgttcaacttcggggactctctggcggacacgggcaactacccgttcgtctatggcaacggctcagccaagctccgtccaccatacggcgagaccttcttccaccgcgccaccgggcgcgcctccaacgggcgcctagtggtggacttcatcgcggacacactcggcctcccgttcgtgcgaccgtatctgagcggacggagcgcggaggacttcgcgggcggggccaacttcgccgtgggcggcgccacggcgctcagcccggacttcttccgtgcaagggggttccacaacatgggaaaccgattggacctcgacatggagatgaagtggttccgcggcct

SEQ ID NO: 41046 - protein, 150 aa, Zea mays
  misc_feature: Ceres CLONE 1435488-F
  misc_feature: SWISSPROT Homolog: EC 3.2.1.51 Alpha-L-fucosidase
MHSSASARGGRGLLLPAAVVVLLLGAVAPAAGCYPRVFNFGDSLADTGNYPFVYGNGSAKLRPPYGETFFHRATGRASNGRLVVDFIADTLGLPFVRPYLSGRSAEDFAGGANFAVGGATALSPDFFRARGFHNMGNRLDLDMEMKWFRG

SEQ ID NO: 41047 - DNA, 646 bp, Zea mays
  misc_feature: Ceres CLONE 1435489-F
  misc_feature: Encodes the peptide sequence at SEQ ID NO. 41048
  misc_feature (169)..(169): n is a, c, t, g, unknown, or other
  misc_feature (193)..(193): n is a, c, t, g, unknown, or other
  misc_feature (344)..(344): n is a, c, t, g, unknown, or other
  misc_feature (347)..(347): n is a, c, t, g, unknown, or other
  misc_feature (356)..(356): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgggcaccggccggcggcaccngcgctcgcagggggctagccaacngagacggcagcaatgggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcncangcgctgacngtggtgacgctgttccccgctgggcgggctgctgctggtgctttcggggctggccctaaccgcctccggggtggggctggcctgggcccccccgggtttcttaattttaagccccgggttttccccccccccgttttttattgggaagggcccattggggttcccccacttgggccccttgggtttcgggggctttcttcttctaatgtttccacaaaaagggggggggggggtttccccccccccccaaaaatatgagggaggccccccccagaggggagaaacccccc

SEQ ID NO: 41048 - protein, 106 aa, Zea mays
  misc_feature: Ceres CLONE 1435489-F
  misc_feature (18)..(18): Xaa is any aa, unknown, or other
MGEQVKGMLHDKGPTASXALTVVTLFPAGRAAAGAFGAGPNRLRGGAGLGPPGFLNFKPRVFPPPVFYWEGPIGVPPLGPLGFRGLSSSNVSTKRGGGGFPPPPKI

SEQ ID NO: 41049 - DNA, 656 bp, Zea mays
  misc_feature: Ceres CLONE 1435491-F
aagctggagctccccgcggtggcggccgctctagaactagtggatcccccgggctgcaggaattcgcacgagaccattacctagaacatcctaatcgaaaacttccccatctccggataaaagataaggagtgtctctcctctctttcagctaagtccctgccccctctctttttcttacattcaggtcctcgcagccgcagctcctctcttttttcttgtttctttcgatctgcgagcagtccgtccaggtccagatccagtactcttctttccgtgaaggaactcttgcagccggcccctctggtttcctcgaattcttgttccccggtccctcctcctgtccccgcgtagatccgtccgtccgaggagcacaccgtccccacccccatggtttacccaccagttcctctgacggccgccgtgctccgatgaagctgagcgtgttccgaatccgccgctcccactccttctccgtcgcctttcctctactggttctacctcttctcaagaacgcatcgcccctctccacctgctgatccctcgctgcccctctctccctccctcttagaaaagcctttgaatcccacctctagggctcttggtttttccccaccccacccccaaaacaaaaaaaaagtccccttggttcaaacc

SEQ ID NO: 41050 - DNA, 667 bp, Zea mays
  misc_feature: Ceres CLONE 1435515-F
  misc_feature: Encodes the peptide sequence at SEQ ID NO. 41051
aaagctggagctccccgcggtggcggccgctctagaactagtggatcccccgggctgcaggaattcgcacgagaccattacctagaacatcctaatcgagaaaaaatctcccaaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggacattcagctcgcccgccgcatccgcggggagcgcgcttaggcgtttacggttgattgtcactactgtagatgtttaggctatgttctcgccatgtcctagg

SEQ ID NO: 41051 - protein, 136 aa, Zea mays; identical to SEQ ID NO: 6923
  misc_feature: Ceres CLONE 1435515-F
  misc_feature (58)..(132): Pfam Name: Histone Pfam Description: Core histone H2A/H2B/H3/H4

SEQ ID NO: 41052 - DNA, 771 bp, Zea mays
  misc_feature: Ceres CLONE 1435528-F
  misc_feature (21)..(21): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (444)..(444): n is a, c, t, g, unknown, or other
  misc_feature (447)..(447): n is a, c, t, g, unknown, or other
  misc_feature (450)..(450): n is a, c, t, g, unknown, or other
gggtgttgttggggggccccnccccctccctgtcggggggganataatnnnnnnnnnaaccaagctggacctccccgcggtggcggccgctctatgactagtggatcccccgggctgctggaggtcacacgagaccattacctacaacatcctaagcgagaaacctccgggtccgccggcgccgttgctcgctctggtcggacccctcggcggccgccggtcgccggcggcggctcgcgtcccgcagatgtggcgcacagagatcggatccgaagcgcgtatcttcgctgcttcccactccgtcgccattgtccccgccgctgctatgggtcagcgggggcgccgcccgcaccggctccgaggggcgggccaagaagaagttggagagcctccgactgcgaggatgatagcggcggtttctgttggaaaaggctgtggaggagntanagntaaaagttccccggcgagaggggcgcccctcgccccccggggggtcccccacgatccccccagggaggcccccctgggcagcctgacgcagacgccggtacccccgaaaatcccgtggtgctgggcagagagctggcgccggggcgtccgggggtaggagtcaaaggggtcgtgcgccgcggcgcccggggggggggcagcgagccggagaaggcttcgcggcgagcggaggggggtcggcgccctgggagggggggcggagttcccgccgagggagccaaccctctctggcctcacccgaccgacgcggtgggtcgtcct

SEQ ID NO: 41053 - DNA, 612 bp, Zea mays
  misc_feature: Ceres CLONE 1435544-F
  misc_feature: Encodes the peptide sequence at SEQ ID NO. 41054
tggagctccccgcggtggcggccgctctagaactagtggatcccccgggctgcaggaattcgcacgagaccattacctagaacatcctaatcgaaaaaaccctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagccggggcgaacattataatcacagcatcgtatcaggctactatccaagggtttgaatcaaagggcttttcaaaagaacaaagtgaaaacttgttaacaaagagtggtcagatttgcactgggaaaccccctggagaattgtttttgaaagggaacttttttgggaaaaaaaaccccccccctttttggggcacccccttttttttttttgggtgtggggcccccccctcctcccaaagagaaagaaaaaggggggggcccctccccctcccc

SEQ ID NO: 41054 - protein, 158 aa, Zea mays
  misc_feature: Ceres CLONE 1435544-F
  misc_feature: SWISSPROT Homolog: EC 2.1.1.10 Homocysteine S-methyltransferase
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSGQICTGKPPGELFLKGNFFGKKNPPPFWGTPFFFFGCGAPPSSQRERKRGGPLPLP

SEQ ID NO: 41055 - DNA, 660 bp, Zea mays
  misc_feature: Ceres CLONE 1435550-F
  misc_feature (174)..(174): n is a, c, t, g, unknown, or other
  misc_feature (320)..(320): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (634)..(634): n is a, c, t, g, unknown, or other
  misc_feature (635)..(635): n is a, c, t, g, unknown, or other
aagctggagctccccgcggtggcggccgctctagaactagtggatcccccgggctgcaggaattcgcacgagaccattacctagaacatcctaatcgaagagcccactcccagaggctcttctcctcctcgcctcctctccctagtctccacgacgcaagggagagtgacgganagcgacgcggcgcgagcgaggagggccaaggcgaagaggggaagcaccgcaccaggacccttgttcgccgcccgcgcctctgatctccgcgaggttgtcaggatttcatatgtcgaccagcacattcgctacttcctgcacgctgntggggcatggtaggacacgcagggctgcccnnnncgcggtgagaggcctttgtctcttagcttcttcagcccagttacgaagggttccaggctggggacttccagaaactggatgtcttcgccctgnnntataccaagggaacctttgcccggccttgagggaaaaaccccaattttatgttccaaaaaaccctaaattctttagcggccggnnnnggccgggggggggttccctaatccggggccgggggggggtttgtcccccccgggcggggaaaatcaaacctgggtcggtgtacccaaccggagggggnnggtggggttaaaaccagacaaaaaa

SEQ ID NO: 41056 - DNA, 652 bp, Zea mays
  misc_feature: Ceres CLONE 1435552-F
  misc_feature: Encodes the peptide sequence at SEQ ID NO. 41057
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
ggagctccccgcggtggcggccgctctagaactagtggatcccccgggctgcaggaattcgcacgagaccattacctagaacatcctaatcgannnaacaacaacgagttaacgaaagccttttatccaagctcaggaaagctcacagtttcgttggatccaatcttagttttatccaagctcagcaatggcttctcgtcagcagcatcctactagctaccacgccggcgagacnnntgtccgtgccgaggagaagacgggtcaagtgatgggggcggcgcaggagaaagggagggaggccaagcacaaggcgtccgacgccgccgaccgcgccatggggatgggccacgacgccagggaggcgaccagggagaaggcgcgcgccgccgcggaccgaaccatggggatgggccacgacgccggggagacggccaaggacagggcgtaccgggccaaggacgcggcctccggtgccgctgtccgcgccagggacactgcgtccgacgcggccggcgctgccggggaccgcgcccacgacggcgcgcagcagaccgggagctacgtcgcgcagacggccgaggccgccaggcagaaggcggccggcgccgcgctgtacgccaaggacaccgtggtggccggcaaggacaagacg

SEQ ID NO: 41057 - protein, 155 aa, Zea mays
  misc_feature: Ceres CLONE 1435552-F
  misc_feature (17)..(17): Xaa is any aa, unknown, or other
MASRQQHPTSYHAGETXVRAEEKTGQVMGAAQEKGREAKHKASDAADRAMGMGHDAREATREKARAAADRTMGMGHDAGETAKDRAYRAKDAASGAAVRARDTASDAAGAAGDRAHDGAQQTGSYVAQTAEAARQKAAGAALYAKDTVVAGKDKT

SEQ ID NO: 41058 - DNA, 653 bp, Zea mays
  misc_feature: Ceres CLONE 1435565-F
  misc_feature: Encodes the peptide sequence at SEQ ID NO. 41059
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
tccccgcggtggcggccgctctagaactagtggatcccccgggctgcaggaattcgcacgagaccattacctagaacatcctaannnaaaaatcccaattggaagggcagctaataaggtaaggggcgacgaaaatggctccaacgaccgccaccaaggacgacagtggctacggcgacgagcgccggcgcgagctgcaggcgttcgacgacacgaagctgggggnnnaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcacgagggcccccgggggaggcgaagcaggcgctctactcgagggacctcgctcgcaacctgcgcttcgcctccaacttcgacctcttcaaggctgctgcggccgactggcgcgacacgctcttctgcgaggtggctccgaacccgccgccgcggga

SEQ ID NO: 41059 - protein, 173 aa, Zea mays
  misc_feature: Ceres CLONE 1435565-F
  misc_feature: SWISSPROT Homolog: EC 1.14.11.20 Desacetoxyvindoline 4-hydroxylase
  misc_feature (31)..(31): Xaa is any aa, unknown, or other
  misc_feature (32)..(32): Xaa is any aa, unknown, or other
MAPTTATKDDSGYGDERRRELQAFDDTKLGXXGLVDSGVKSIPSIFHHPPEALSDIISPAPLPPSPPSGAAIPVVDLSVTRREDLVEQVRHAAGTVGFFWLVNHGVPEELMGGMLRGVRQFTRAPGGGEAGALLEGPRSQPALRLQLRPLQGCCGRLARHALLRGGSEPAAAG

SEQ ID NO: 41060 - DNA, 575 bp, Zea mays
  misc_feature: Ceres CLONE 1435568-F
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (175)..(175): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (229)..(229): n is a, c, t, g, unknown, or other
aaagctggagctccccgcggtggcggccgctctagaactagtggannncccgggctgcaggaattcgcacgagaccattacctagaacatcctaatcgaaaaaacatattattgagaccaactagcaacatagaaagcacaatagtgtaccaacaatggcagccaaaatattttngctccttatgnnncttggtctttctgcaagtgctgctacggcgaccatttcccnacatgctcacaagctctatagcttccttttcttcctcgtacctctcaacaggcgtggtcttggttatggaaaaactattcctccaccttaaccggatccaacagggaattgcacctggatcttacctttaacacccttgtcccccaaaaatcatagcccttttaagaagttacctttggggattttttggccaaaaactctggggccaaaaatacaaaaatttgtgaaaaaaactttgtggcctctttcaaaaaaataatttttttcttttcacacaaaagggggggaaaaacccgtttcttttttgcaaaaaaaaaaaaactttttccccgctattttttggccc

SEQ ID NO: 41061 - DNA, 561 bp, Zea mays
  misc_feature: Ceres CLONE 1435569-F
  misc_feature (234)..(234): n is a, c, t, g, unknown, or other
  misc_feature (298)..(298): n is a, c, t, g, unknown, or other
  misc_feature (378)..(378): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (539)..(539): n is a, c, t, g, unknown, or other
tccccgcggtggcggccgctctagaactagtggatcccccgggctgcaggaattcgcacgagaccattacctagaacatcctaatcgaaaaacagtgcctctcgctcactgactgactgtaataccagagatcgaacaacttggtcctgcagctcaagaagagagtttttgtgcatttgggggccgggggcaagagagagagagagagccatggcggcggaccagcagccgcangctgcaggaggagatgaacgacgctgcccgggggcgggccctcagggctggcctccccgggggntcctcgcttcccccccgagaggaagtttctaaaattggggcagagggttttttcccccccccccaagaagaagggcgccntgctnnnnaataaaaaaaccaccgcggtttttcattctcttggcggcccccgtcccgcgggggggggggaaccnnnnaaagaaaggggggggcgggggggccccccctccccgggggggaaaaaagggggggggaaaaaaaagggggtttcccttcggggnaacatcccttccgacctttccc

SEQ ID NO: 41062 - DNA, 652 bp, Zea mays
  misc_feature: Ceres CLONE 1435573-F
  misc_feature: Encodes the peptide sequence at SEQ ID NO. 41063
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (652)..(652): n is a, c, t, g, unknown, or other
ctccccgcggtggcggccgctctagaactagtggatcccccgggctgcaggaattcgcacgagacnnntacctagaacatcctaatcgaaaaaatcgagcatcgcagagataggcgtcttcgtactcgcctacctccgcggctcaaacctttcccccttctcccaattccctccgtcggcnnncgctccatcccgtacgacgacaccatgagggagtgcatttcgatccacatcggccaggccggtatccaggtcggaaacgcgtgctgggagctgtactgccttgannntggcattcaggctgacggtcagatgcccggtgacaagaccattgggggaggtgatgatgctttcaacaccttcttcagtgagactggtgctgggaagcacgtgccccgtgctgtnnnngttgaccttgaacccactgtcatcgatgaggtgaggactggcacctaccgccagctcttccaccctgagcagctcatcagtgggaaggaggatgcagccaacaactttgcccgtggtcactannncattggcaaggagattgttgacctatgccttgatcgcatcaggaagcttgccgacaactgcactggtctccagggcttcctcgtcttcaacgctgttggtggaggaacgggctctggcn

SEQ ID NO: 41063 - protein, 148 aa, Zea mays
  misc_feature: Ceres CLONE 1435573-F
  misc_feature (49)..(148): Pfam Name: Tubulin Pfam Description: Tubulin/FtsZ family, GTPase domain
  misc_feature (27)..(27): Xaa is any aa, unknown, or other
  misc_feature (28)..(28): Xaa is any aa, unknown, or other
  misc_feature (67)..(67): Xaa is any aa, unknown, or other
  misc_feature (108)..(108): Xaa is any aa, unknown, or other
  misc_feature (109)..(109): Xaa is any aa, unknown, or other
MRECISIHIGQAGIQVGNACWELYCLXXGIQADGQMPGDKTIGGGDDAFNTFFSETGAGKHVPRAVXVDLEPTVIDEVRTGTYRQLFHPEQLISGKEDAANNFARGHXXIGKEIVDLCLDRIRKLADNCTGLQGFLVFNAVGGGTGSG

SEQ ID NO: 41064 - DNA, 664 bp, Zea mays
  misc_feature: Ceres CLONE 1435593-F
  misc_feature: Encodes the peptide sequence at SEQ ID NO. 41065
  misc_feature (367)..(367): n is a, c, t, g, unknown, or other
ggagctccccgcggtggcggccgctctagatctagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcnctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagaccaaagaggtggcggctgtggaggctaacgaggaggaggaggaggcaccgcctgctggtgctgccactc

SEQ ID NO: 41065 - protein, 143 aa, Zea mays
  misc_feature: Ceres CLONE 1435593-F
  misc_feature (45)..(45): Xaa is any aa, unknown, or other
MAAVEVQVPTAAPVEEAAQLAAASAVETPNEETAAPAVETEVVVXKEPEPVEAETETETKEAEAVAEPTEAEPKEAEPEAAAPAAETEVKEAETEAAAPAAETEAAAAPVEAAEPEIAAETKEVAAVEANEEEEEAPPAGAAT

SEQ ID NO: 41066 - DNA, 643 bp, Zea mays
  misc_feature: Ceres CLONE 1435594-F
  misc_feature: Encodes the peptide sequence at SEQ ID NO. 41067
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaaacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattcggttggatccagcatatgcaggacgaggatgcaggccggccatacaggaagttcctgtaagcggcgtccagggccgcaggagacgtcgatccctcgaccggggctgcgaggaggggagtttccattcagtttgtgtcggtattgttttagtctgaatctgatggagcagtttggaatgctgaactattgtgcctgatccaaaatgaataggtgtaatgactcgtctttttcatttactgaaactgacatgtttgaatttatctggtcactggtatggtaaaatagcagcgttngtcatggtcatatactggttatgacttcattcgagcgccg

SEQ ID NO: 41067 - protein, 75 aa, Zea mays
  misc_feature: Ceres CLONE 1435594-F
MGGGMEVHKNRWIEEWNAGRENLEFNFRWTRRSLAVVGLFGLAVPILVYKGIVREFGWIQHMQDEDAGRPYRKFL

SEQ ID NO: 41068 - DNA, 668 bp, Zea mays
  misc_feature: Ceres CLONE 1435595-F
  misc_feature: Encodes the peptide sequence at SEQ ID NO. 41069
ggagctccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctagtcctgttcagattactcgtggtatcgaggaaacagcgaa

SEQ ID NO: 41069 - protein, 158 aa, Zea mays
  misc_feature: Ceres CLONE 1435595-F
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGASPVQITRGIEETA

SEQ ID NO: 41070 - DNA, 800 bp, Zea mays
  misc_feature: Ceres CLONE 1435607-F
  misc_feature: Encodes the peptide sequence at SEQ ID NO. 41071
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
gtgggggcccnntnnggtgtcttagactcgcagggggggnnnnnnnnnngntcaaactgggactccccgcggtggcggccgctctattaactagtggatcccccgggctgcaggaattcgcacgagaccattacctagaacatcctaatcgaaaacattttggctcctctctgccgcgccgccaccccctactggtaaggaagaggagggcaggatgtcgcaccgtaagttcgagcacccgaggcacggctccctcggcttccttcccaggaggggctcctcccgtcaccgcggcaaggtgaaatcattccctagggatgaccccaagaagcctggcgatctcatggccttccttggctacagggttggcatgactcccttggtcctttgaggtggagaagcggggggtagaaattctttaagaagggaaactttggagggggggttgcggttgtttaaaagtttttgttggtgggggcccccccccctccgtggcgattgtgaaagagtccgtgggggcgctccgcgtgacgttcaactcttgttttggggccccacctttcctttagttaaggagggggagggaagaagggttccttcttagaaatctggggtgcaaacacgcaacgaaaaaagcggttttcccaaaagggtagggcttctccatatttggaaaaagggatgggggcggcgaggaagagaaatttttaacgtggcaccgttgggggaaggagtggaggaaaagcgggcggttcccggctacagcgggcggggacggggcccgagaccgccggggagga

SEQ ID NO: 41071 - protein, 58 aa, Zea mays
  misc_feature: Ceres CLONE 1435607-F
MSHRKFEHPRHGSLGFLPRRGSSRHRGKVKSFPRDDPKKPGDLMAFLGYRVGMTPLVL

SEQ ID NO: 41072 - DNA, 654 bp, Zea mays
  misc_feature: Ceres CLONE 1435609-F
  misc_feature: Encodes the peptide sequence at SEQ ID NO. 41073
ccccgcggtggcggccgctctagaactagtggatcccccgggctgcaggaattcgcacgagaccattacctagaacatcctaatcgaaaaaaaaaccgcaccgcaccgcaacgcgccaccgatccaccccgcgtcctcggcctccctccctccggcgagcggcggcgcgggcggccatggaggtgttctactacgtcgtgttcggcgcgctggccgccatcgtggcggggctcgagctcggcaagagcggcaaggaccgcgtcgccactacctccgcctttaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctccatgctcttcggcaccatcgtcggctccctcgccgacaaacaaggccgcaagagggcctgcatcacctactgcatcagctacatcctcagctgcatcaccaagcactcccccgagtacagggtcctcatgatcggccgcatcctcggaggcatcgccacttcgctgctcttctccggcttcgagtcctggctcgtcgcagagcacaacaagagaggctttgacc

SEQ ID NO: 41073 - protein, 159 aa, Zea mays
  misc_feature: Ceres CLONE 1435609-F
  misc_feature (4)..(159): Pfam Name: DUF791 Pfam Description: Protein of unknown function (DUF791)
MEVFYYVVFGALAAIVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSGFESWLVAEHNKRGFD

SEQ ID NO: 41074 - DNA, 726 bp, Zea mays
  misc_feature: Ceres CLONE 1435615-F
  misc_feature: Encodes the peptide sequence at SEQ ID NO. 41075
  misc_feature (354)..(354): n is a, c, t, g, unknown, or other
aagctggagctccccgcggtggcggccgctctagaactagtggatcccccgggctgcaggaattcgcacgagaccattacctagaacatcctaatcgaaaaaccaccaaaccaatcgctggatttgtccagagtatttccggtttcaccgccctagatctgacccgagacgccgcgtcttcgctgagatggcgattactgtgaggcggtcgacgatggtgcgcccggcgcgggagacgccgcggcagcggctgtggaactccaacctcgacctcgtggtgccgcgcttccacacgcccagtgtctacttctaccgccgcgacggccccgtgccggatgcggagggggttcttcnacggcaagcggatgcggcgccccctggcagaggggggcgtgccgttctatccaatgggggggccccctccccccggaacgaggacggaagggtcgagatcaactgcaagggcaagggaatgctcttttcgcaaggccgacgccccccaagccctctggcaataactacgggaccttcccccccccccagggaacttaagccgcctttaccccgaaccgtaaattacacccaaagaattttcggcccttctcccatccctcggggccccaggtggacttttatttcaaatgggggggggccccccccccttgggtgttggccagcccaccccccttgcaaggggaaagggaattgtcctgggcttggccactt

SEQ ID NO: 41075 - protein, 179 aa, Zea mays
  misc_feature: Ceres CLONE 1435615-F
  misc_feature: SWISSPROT Homolog: EC 2.3.1.144 Anthranilate N-benzoyltransferase
  misc_feature (56)..(56): Xaa is any aa, unknown, or other
MAITVRRSTMVRPARETPRQRLWNSNLDLVVPRFHTPSVYFYRRDGPVPDAEGVLXRQADAAPPGRGGRAVLSNGGAPSPRNEDGRVEINCKGKGMLFSQGRRPPSPLAITTGPSPPPRELKPPLPRTVNYTQRIFGPSPIPRGPRWTFISNGGGPPPLGCWPAHPPCKGKGNCPGLGH

SEQ ID NO: 41076 - DNA, 689 bp, Zea mays
  misc_feature: Ceres CLONE 1435617-F
  misc_feature: Translation starting site: 191
aagctggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgccacctgcttaccacttggatcctggctccggagcgggcagcagaagctggattgtgaacttagagggaggtgcgtggtgcaacagcgccaagacatgccggctcaccaggagctccggccgtggctcgtcggaccacatggacaaagagatccccttcaccggcatcatgagcagcagccgtaccgtgaatcctggtctcgcccgattctaatttctacatctggaaccgggtcaaggttcgctactgtgacggtggatcttttgccggc

SEQ ID NO: 41077 - DNA, 670 bp, Zea mays
  misc_feature: Ceres CLONE 1435618-F
  misc_feature: Encodes the peptide sequence at SEQ ID NO. 41078
ctggagctccccgcggtggcggccgctctagaactagtggatcccccgggctgcaggaattcgcacgataccattacctagaacatcctaatcgaaaaatcacgtctcgcatgttgcgcactggccggcgggcggcgccgctcagctctttcctataaatagggcacaggccacagggaagaagggcaccggccggtgttggtttaagcttgtattcccacactctgtcgcagcgtcgcccgtcgccgctgagatcctagctaggaagaaatggagctctctcgcaagctcttcacggccgtcctcctcgtcatgctgctgctgctgtccgcagaggtcgggccggtggcggtggcggaggcgcggacgtgccagtcgcagagccacaggttccggggcccctgcctccgccggtccaactgcgccaacgtctgcaggaccgaggggttccccggcggcaggtgccgcggcttccgccgccgctgcttctgcaccacgcactgccactgattcgctcgcccagcggccggctggcgtcgccgtcgatcgcgcgcgtcgcgaccagtccatggctccatgcatgaataacaagggtgtgcggtttgtgatgccaaattgtatccctctcgtcgtgtgttgaagcgttcgatcgtcggtctagtagtgtgct

SEQ ID NO: 41078 - protein, 79 aa, Zea mays
  misc_feature: Ceres CLONE 1435618-F
  misc_feature (32)..(78): Pfam Name: Gamma-thionin Pfam Description: Gamma-thionin family
MELSRKLFTAVLLVMLLLLSAEVGPVAVAEARTCQSQSHRFRGPCLRRSNCANVCRTEGFPGGRCRGFRRRCFCTTHCH

SEQ ID NO: 41079 - DNA, 672 bp, Zea mays
  misc_feature: Ceres CLONE 1435630-F
  misc_feature: Encodes the peptide sequence at SEQ ID NO. 41080
  misc_feature (546)..(546): n is a, c, t, g, unknown, or other
  misc_feature (592)..(592): n is a, c, t, g, unknown, or other
  misc_feature (614)..(614): n is a, c, t, g, unknown, or other
  misc_feature (615)..(615): n is a, c, t, g, unknown, or other
ctggagctccccgcggtggcggccgctctagaactagtggatcccccgggctgcaggaattcgcacgagaccattacctagaacatcctaatcgaaaaaagaaagaaagaaagaaaaggggcaggaagaaatcgagcctcactcgatccatcgcctcgccgcagcacacacgaggccggcggcgccatggccatgaagctggacatgtgcgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcacaaaccgtgaggaaaattattgaaataaatccttacatgctggggacaatggctggaggtgctgctgattgccattttggcataggaacctangaaccagtgtcgtctccatgagctttcaacaagcgaaggatctctnatgctggtgcttccaacgtgtnngctacatcctttatcatatcgtgggatgggactgtcgattggtacatgatcgctgga

SEQ ID NO: 41080 - protein, 126 aa, Zea mays
  misc_feature: Ceres CLONE 1435630-F
  misc_feature: SWISSPROT Homolog: EC 3.4.25.1 Proteasome endopeptidase complex
  misc_feature (120)..(120): Xaa is any aa, unknown, or other
MAMKLDMCALETNFANLTASAGDDTYFSAEAPDVPSMVLPICDDFDGFQAATKDMVKNKKGTTTLAFIFDKGVIVAADSRASMGGYISSQTVRKIIEINPYMLGTMAGGAADCHFGIGTXEPVSSP

SEQ ID NO: 41081 - DNA, 705 bp, Zea mays
  misc_feature: Ceres CLONE 1435637-F
  misc_feature: Encodes the peptide sequence at SEQ ID NO. 41082
  misc_feature (627)..(627): n is a, c, t, g, unknown, or other
tggagctccccgcggtggcggccgctctataactagtggatcccccgggctgcaggaattcgcaccagaccattacctagaacatcctaatcgaaaaaatccgaattggatcgccacttaataaggtacggggcgacaaaaatggctccaacgactgccaccaaggccgatagtggttacagctacaagcgccggcgcgagctgcaggcgttcgacgacacgaagctggcggtgaaaggtctggtggactccggcgtcaagtcgatctcgtccatctctcaccacccgccggaggctctgagcgacataatttcgccggcacctctgcggccgtccccgccctctggtgcggccatcccggtggtggacctcttggtgatgcggagcgagtgacctaatttagcaggtgaggcccaccccctcgaaggttggtcttcttttggctggtaaaccacgaatggccggaagagcttaatgggcggcagccccgcgggatgcgtcagtttaactaaggccccggtggagggaaaaaccatgccctttactttgggggaaccacccttcgcaccttggggtttcccttcccattttcaacctttttcaaaggttgttccgggataaatgggngccaaccccttcccttctgggaagttgggattgggaaacccctccgccccaagtgaagggaatttccagcaaatctac

SEQ ID NO: 41082 - protein, 83 aa, Zea mays
  misc_feature: Ceres CLONE 1435637-F
  misc_feature: SWISSPROT Homolog: EC 1.14.11.20 Desacetoxyvindoline 4-hydroxylase
MAPTTATKADSGYSYKRRRELQAFDDTKLAVKGLVDSGVKSISSISHHPPEALSDIISPAPLRPSPPSGAAIPVVDLLVMRSE

SEQ ID NO: 41083 - DNA, 772 bp, Zea mays
  misc_feature: Ceres CLONE 1435639-F
  misc_feature: Encodes the peptide sequence at SEQ ID NO. 41084
  misc_feature (64)..(64): n is a, c, t, g, unknown, or other
  misc_feature (755)..(755): n is a, c, t, g, unknown, or other
tccctcctctcctctcccgtatcttgaatagccctttgtcgttcctgcatgttttttggtcttncgccgccagctcaagagtgctggtgcatccccgggctgtctgaattcgcacgagacattacctagaacatcctaatcgaaaaataaacgaccacgcgcccacggtgaactgcttgtctagggttcagggataaaagacccgctcctgtcccgcaggcaactgagcgccggcccgcccgcccgcccaccagccgccgccgcaccgccaccgcgcgacctcccttcttcgccgcaaaccgctctgggcgcttgaagatggcggtgccgctgttgactcaaaagatcgtgaagaagcgggtcaagcagttcaagaggccccacctcgaccgctacaagtgcctcaagccaagctggcgcaggcccaagggtatcgactcccgtgtcaggcggaagttcaagggatgcaccttgatgcctaacattggatatggctctgacaagaagaccaggcactatcttcccaacaagtttaagaagtttgtcgtgcacaatgtttctgagctggagttgcttatgatgcacaacaggacatactgtgctgaaatcgcacacaacgtgtccactaagaagcgcaaggaaatcgtggagcgagctgctcagcttgacattgtggtcaccaataagcttgcccgtctccgcagccaggaagaatgataaactggttctactagcagtagttttttgtatggtgntgctttagaagacttgg

SEQ ID NO: 41084 - protein, 132 aa, Zea mays
  misc_feature: Ceres CLONE 1435639-F
  misc_feature (14)..(123): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKKTRHYLPNKFKKFVVHNVSELELLMMHNRTYCAEIAHNVSTKKRKEIVERAAQLDIVVTNKLARLRSQEE

SEQ ID NO: 41085 - DNA, 657 bp, Zea mays
  misc_feature: Ceres CLONE 1435646-F
  misc_feature: Encodes the peptide sequence at SEQ ID NO. 41086
  misc_feature (354)..(354): n is a, c, t, g, unknown, or other
tgcggaattcgcacgagaccattacctagaacatcctaatcgaaaaccgtttctcggcatcgtcgacacctccatcggcctccgatctctccacgagcctccgctccaatccgaggatctgcggcggtgggcagtggtcggccggcgatggcgcaccgagtggacaacgagtacgactacctcttcaagatcgtgctcatcggcgactccggcgtcggcaagtccaacatcctttcccggttcacccgcaacgagttctgcctcgagtccaagtccaccatcggcgtcgagttcgccacccgcaccctccagatcgaagggaaaaccatcaaagctcaaatatgggatactgcngggcaagagaggtaccgtgcaatcacaggtgcttactacggagggagcgtgggtgcacttctagtctatgacctccgaaaaagcaaacttttgaaacctacagaggtggctccccgaggctccgggaccacccggcccccaaatccggatctggatggcggggacaagcccaacctgaccccctgggggccgttccaaaagaaaaggggccgcctttaccaaaaaggagggttttccttcccagagaatccccccgaaccctttagggagaaggggttttaaacccccccccaaaatccaaac

SEQ ID NO: 41086 - protein, 162 aa, Zea mays
  misc_feature: Ceres CLONE 1435646-F
  misc_feature (14)..(160): Pfam Name: Ras Pfam Description: Ras family
MAHRVDNEYDYLFKIVLIGDSGVGKSNILSRFTRNEFCLESKSTIGVEFATRTLQIEGKTIKAQIWDTAGQERYRAITGAYYGGSVGALLVYDLRKSKLLKPTEVAPRGSGTTRPPNPDLDGGDKPNLTPWGPFQKKRGRLYQKGGFSFPENPPEPFREKGF

SEQ ID NO: 41087 - DNA, 714 bp, Zea mays
  misc_feature: Ceres CLONE 1435647-F
  misc_feature: Translation starting site: 199
  misc_feature (546)..(546): n is a, c, t, g, unknown, or other
  misc_feature (633)..(633): n is a, c, t, g, unknown, or other
caaagctggagctcaccgcggtggcggccgctctagaactagtggatcccccgggctgcaggaattcgcacgagaccattacctagaacatcctaatcgaaaagttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgaatggcaaggtcaggactgaacaaaacctaccctgctgggttcatggatgtcatttccatccccaagacaatggaaaactacaggctgctttataacactaggggccgcttccgtcttcacccaatcaggnatgaggatgccaagttcaagctctgcaaggtgaggtctgttcagtttggcagaaaggcatcccctacctgaaaacttacgaaggcgnaccatcggtaacccggacccgttataagggcaaggacccttcaaaatcaatctggaaccaaaaaaatctggctttctcaat

SEQ ID NO: 41088 - DNA, 698 bp, Zea mays
  misc_feature: Ceres CLONE 1435648-F
  misc_feature: Encodes the peptide sequence at SEQ ID NO. 41089
cagaactagtggatcccccgggctgcaggaattcgcacgagaccattacctagaacatcctaatcgaaaaaagacgtacaagcacacggccaccgaaccaaccaagcagcatcggaccagcgggcgcatcgatcgagccagtatactcctcgaccggccatagaagcataataacactacagggggtggagcggagaggtagatggcgagcgggagcggcaaggcgaaggcgtcgtcgtgggcggcggcgatgagcgtcggcaccgtggaggcgctcaaggaccaggccggcctgtgccgctggaactacgcgttccggcaggcggcgcagcagcagaagcagcgcgccaggaggccagcggcaggcgcgagcggctcagtcggccccggcagcggcagcggcagcgcgcacgcgccgcctgcttctgctccctcgggctgcgccgcggcggcgaggaggagagccaggcagcagcaggaggaggagctccggacggtcatgtacctcagcaactggggtcccaacaactagctacgaactaccagtagctggtgatcgagcaggcgaagcgaagctgggcgggcaacaacctgagatgactccgagggcccgtgtcaagcaaccttgcctctagctagctatgctagtaggcgctgccgcttactctagtctgctgtacgaacgacatggccagtcc

SEQ ID NO: 41089 - protein, 109 aa, Zea mays
  misc_feature: Ceres CLONE 1435648-F
MASGSGKAKASSWAAAMSVGTVEALKDQAGLCRWNYAFRQAAQQQKQRARRPAAGASGSVGPGSGSGSAHAPPASAPSGCAAAARRRARQQQEEELRTVMYLSNWGPNN

SEQ ID NO: 41090 - DNA, 765 bp, Zea mays
  misc_feature: Ceres CLONE 1435652-F
  misc_feature: Encodes the peptide sequence at SEQ ID NO. 41091
  misc_feature (348)..(348): n is a, c, t, g, unknown, or other
  misc_feature (354)..(354): n is a, c, t, g, unknown, or other
  misc_feature (378)..(378): n is a, c, t, g, unknown, or other
  misc_feature (427)..(427): n is a, c, t, g, unknown, or other
acccgcggtggcggccgctctagaactagtggatcccccgggctgcaggaattcgcacgagaccattacctagaacatcctaatcaaaaactaacgctgtccgccgccacctctcctccggcatcgacgaggcgaaaccctagcgcccgagtccctctccctgctcccacaacccatggcggcggatatggcgtacgcgccgccgatgaaggctggcaaggccgggttcgaggctggcatgatggatccacagcacaggatccgcatcacgctctcctcccagagcgtcaagaacctcgagaaagtctgcggggatctggtgaagggcgccaaggggtaggagctcanggtcanggggccccgtgcggatgcctaccnaggtgctccacatcacccacagggagttctccctggggagaaagtaccnacacctggggatcgctttggatgaggattcccaaagagggtgatcgattcccgtcagtaccccaaacgttgggcagagcaatccccctcatccccattgaacccgggggtccgagggttaggtgaccattccgggggccccttaaatgggggccctttaccttttccaaaggggtttcgtgggaacgggaatttctccattcccccagggaaaaattgtgggaaaaaagaaacccccagtttttcttacaaaattttaaaacttttttccgggggggcccgcgggagagaggatacccccgtgttaaaaaaaatttctcccacgagggaggagaaaag

SEQ ID NO: 41091 - protein, 54 aa, Zea mays
  misc_feature: Ceres CLONE 1435652-F
MAADMAYAPPMKAGKAGFEAGMMDPQHRIRITLSSQSVKNLEKVCGDLVKGAKG

SEQ ID NO: 41092 - DNA, 730 bp, Zea mays
  misc_feature: Ceres CLONE 1435660-F
  misc_feature: Encodes the peptide sequence at SEQ ID NO. 41093
aagctggagctccccgcggtggcggccgctctagaactagtggatcccccgggctgcaggaattcgcacgagaccattacctagaacatcctaatcgaaaaatccatcttcaagccagccgtctccttatccctgcgatgccgctcacctgggctcatcttccagtcgccctctccgcccagcagcagagcacaccatcctctccactcggatccccaagccctcgcctctagctcttgccacggcatccatcccctgctcggacctccacccggccgcgtcctcgccggtggccagcgccgctgcatcgcccttcctagcgtcggccttggcaccgcttccccgagcgccccagtcgagctcgcccatcctctgctctagccctttctccacgccgtcgctgagctcgcccctcccctcagccatggacacgacgacctgcagcccttcttggtggccaagcccatcttcctactcgcgccccctctttttccacctctgcgcgtatcagctcgtccaacccccatggtgtttcctccctctcggctcccttgctccctccccatggcgttccccctggatgttggtgatctgttccccacgatgcaggcaaatgttctttccctccctgcagcagcaccttggtggttgtcgagcagcacgtcgcgcttgcgcagcctcggtcacgacgttgttcaccccggtacgctagtgatcgagatgcgaaggc

SEQ ID NO: 41093 - protein, 55 aa, Zea mays
  misc_feature: Ceres CLONE 1435660-F
MAFPLDVGDLFPTMQANVLSLPAAAPWWLSSSTSRLRSLGHDVVHPGTLVIEMRR

SEQ ID NO: 41094 - DNA, 724 bp, Zea mays
  misc_feature: Ceres CLONE 1435663-F
  misc_feature: Encodes the peptide sequence at SEQ ID NO. 41095
  misc_feature (675)..(675): n is a, c, t, g, unknown, or other
gggtggcggccgctctagaactagtggatcccccgggctgcaggaattcgcacgagaccattacctagaacatcctaatcgaaaaacataccctatctcttcccagtcttcctacgctcctgtcggcgcgtcctccgcatcccggtgaccggtgttctccgatttgaggggcgtcccttgcacgctccggtctgctgctcctccgccctccggagtccattccagcggagcgcgctacggcacagatcggccgccgtccatccctttcccagctctccaaagcctccgccgccgcgtccggtgagcacgtctcgaccggtttccaaataactgcataaggccgagctcatgcaaaatggtgctatgccagggcgtatctgttggaaatgctcagttgctagcttttcctggtagatcatcaagccttaagagcacccagtttcttgttaaaacgaatcattttcctgcaaaagctctacgtgttggtactgattctattcatcatgccatgcctacatcatccccaagggaaaattctgtcaggggaatcccatcactatcaagaacagcacaatcagcatccaaggtccgttagttgtcaggcatcctcactggcatctttcagctaccctgagctgacatccaaaccccagatggtggtagagactcctagcnttgtgtgccgtacttgctgccactgcacaacatgtggtcttatgctgaa

SEQ ID NO: 41095 - protein, 79 aa, Zea mays
  misc_feature: Ceres CLONE 1435663-F
MVLCQGVSVGNAQLLAFPGRSSSLKSTQFLVKTNHFPAKALRVGTDSIHHAMPTSSPRENSVRGIPSLSRTAQSASKVR

SEQ ID NO: 41096 - DNA, 726 bp, Zea mays
  misc_feature: Ceres CLONE 1435672-F
  misc_feature: Encodes the peptide sequence at SEQ ID NO. 41097
aagctggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaggctctgaagtcccctttgatgggcctattcgagaagcgcagagcaaggaacttcttcatttatgtccaagattacaatgaagctgatccaaggacacatcaaggattggaccttactagggtgaccactagagaacttatagcaaaatatggtttaagtgatgatacagtggaattcg

SEQ ID NO: 41097 - protein, 183 aa, Zea mays
  misc_feature: Ceres CLONE 1435672-F
  misc_feature (1)..(183): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRTHQGLDLTRVTTRELIAKYGLSDDTVEF

SEQ ID NO: 41098 - DNA, 817 bp, Zea mays
  misc_feature: Ceres CLONE 1435675-F
aaaccaatccccaccattctcccttcccgccttcccgacgcccccccccaaagatggagctccccgcggtggcggccgttctacaactagtggatctccccggctgcaggaattagcacgagaccattacctagaacatcctaatcgaaaaaactactccgtcactttggttgccaagctcctcctcgatccatcgatcattgaaccggccggcggcaccgcgctcgcaggggctagccaacgagacggcagcaatggcggaccgtgaccgcagcggtatctacggcggcgcccacgccacctacgggtagcagcagcaaaatggaggaggcgggcgcccgatgggtgagcaggtgaagggcatgctccacgacaaggggccgacggcgtcacaggcgctgacggccggcgacactgttctcgttgggtgggctgctgccggagctgatggtcctggaacctccccgcctctgtggtgggggctggccgtggacacaccggtgtctcctgatcttcagcccctagctggtccccgttcgcgcctgctctttcgtgacgggccgacatggggtcctttcacctctggtccctctggggtttaagggggcctggtccttttttcacggtgccctggactaaaccggtaccgggcagggagttcccgagggaactaccagacttacgggcgacggaggcctcaacctcaggaaattgcggaaatgctcgctattactctacgacgaccatcaggatcctcttccacgttcacgcccatggcacattccatatggcacggcctccttattacgctcccccc

SEQ ID NO: 41099 - DNA, 700 bp, Zea mays
  misc_feature: Ceres CLONE 1435680-F
  misc_feature: Encodes the peptide sequence at SEQ ID NO. 41100
  misc_feature (300)..(300): n is a, c, t, g, unknown, or other
  misc_feature (560)..(560): n is a, c, t, g, unknown, or other
  misc_feature (575)..(575): n is a, c, t, g, unknown, or other
  misc_feature (578)..(578): n is a, c, t, g, unknown, or other
  misc_feature (593)..(593): n is a, c, t, g, unknown, or other
ccgctctagaactagtggatcccccgggctgcaggaattcgcacgagaccattacctagaacatcctaatcgaaaaacttgcttcaatactagctcgctcaccactcaccagtcaccagtccagcaagcaacaacaaaggcgtaggaggaagcttgttttggaccgagcaagcgagccagccgagcgtgggagagagagaaagaggaattaattgatgggcgaggaggccagctgcgacgccgtcagcctgacggaggccggcaccaacccacggtgggaaaagggggggaggtcccccnaaagccggttgcagcccccgccgccgcggccgacccccggctgcagggcatttccgacgccatccgcgtcgtgccgcacttccccaagcaaggcatcatgttcaacgacatcaccacgctgctgctgcgccccagggtgttcaaggacgccgtcgacctgttcgtcgagcggtaccgcgggatgggcatcgacgccgtcgccgggattgaggccaggggcttcgtgttcggcccggcgatcgcgctggctattggcgccnagtcatacctctgcngangcaaggaagctcccnggtgagtgatctccgagagtacgttctcgagtacgggactgattgcctgaaaatgcttgtcggggcatcaagcgacccggcaagggggtgctgggctcaacaacctg

SEQ ID NO: 41100 - protein, 65 aa, Zea mays
  misc_feature: Ceres CLONE 1435680-F
  misc_feature: SWISSPROT Homolog: EC 2.4.2.7 Adenine phosphoribosyltransferase
  misc_feature (55)..(55): Xaa is any aa, unknown, or other
  misc_feature (60)..(60): Xaa is any aa, unknown, or other
  misc_feature (61)..(61): Xaa is any aa, unknown, or other
MFNDITTLLLRPRVFKDAVDLFVERYRGMGIDAVAGIEARGFVFGPAIALAIGAXSYLCXXKEAP

SEQ ID NO: 41101 - DNA, 728 bp, Zea mays
  misc_feature: Ceres CLONE 1435682-F
  misc_feature: Encodes the peptide sequence at SEQ ID NO. 41102
  misc_feature (728)..(728): n is a, c, t, g, unknown, or other
aaagctggagctccccgcggtggcggccgctctagaactagtggatcccccgggctgcaggaattcgcacgagaccattacctagaacatcctaatcgaaaaactcaacacgcacgggccaggcccagctcagaggcaaaaacccacaccacacttcgttccccttgtcccaattgctcctccacttcccccaccgcccaccagtgatctcgccgccgcgacgcgaggcaccacggccggcgccggccgccttcctccagaaagtatcccccgtgcgcccgaatcacctcttaatttcgttcttagccgctgcgtttcacagaggtcgcgacatgcccgcctcggcggctcctcctgcccagcccgcggcaccgccccctcctcctcctcccgcttctcctgcccctccggaggatgtggaggcgactgccggttcaccttcgagggcttcagcagtggggacggtgaactggggaacggccaccctcgttggcgtcttcgctgggctgctatacggggggagcagggaggcctccgcttccgtcagtaaggatgccgaggtgatgctgaagatgggaagcacaactgacaagcgtgaacagtatagattgatgagagatgctatggagaaaaggttcattcgggttgccaaaggttcactagtcgggggtgttcggctggggatgtttactgcgaccttcttggcatacagaaccttcttatcgatn

SEQ ID NO: 41102 - protein, 131 aa, Zea mays
  misc_feature: Ceres CLONE 1435682-F
MPASAAPPAQPAAPPPPPPPASPAPPEDVEATAGSPSRASAVGTVNWGTATLVGVFAGLLYGGSREASASVSKDAEVMLKMGSTTDKREQYRLMRDAMEKRFIRVAKGSLVGGVRLGMFTATFLAYRTFLS

SEQ ID NO: 41103 - DNA, 694 bp, Zea mays
  misc_feature: Ceres CLONE 1435686-F
  misc_feature: Encodes the peptide sequence at SEQ ID NO. 41104
aagctggagctccccgcggtggcggccgctctagaactagtggatcccccgggctgcaggaattcgcacgagaccattacctagaacatcctaatcgaaaaaatacgaggcctggcctaccacctgcgacaaaccagtcaccgcctaccaccgttttataatccacccctcccactccccctgttttttcttcttccgctgttctactccggcgtgttggtcgacggcggcgcagatgacgaccctcgatctgatgggagggtacgggcgggtggacgagcaggtggccatccaggaggccgccacggcggggctgcgcgggatggagcgtctcatcttgcagctctcccaggctggcaccggggagcggtcgttgtccccaccggcggtacaggcgcagcgccagcagcagaagcagctggagcagatccagcagcaggttgactgccgggagctcacggacatgacggtgtccaagttcaagaaggtgatctccatcctgaaccgcacggggcacgcgcggttccggcgtggccccgtggcggcgcggtcgcagtcgcagtcgcagggacctgcctcccccgagcccgcgcaatcggcgccggctcccgccgcgaggcccctgacgctggacttcaccaagtcggtgtccggttacagcagggactcctggttcagcgtgtccggcgcgagc

SEQ ID NO: 41104 - protein, 153 aa, Zea mays
  misc_feature: Ceres CLONE 1435686-F
MTTLDLMGGYGRVDEQVAIQEAATAGLRGMERLILQLSQAGTGERSLSPPAVQAQRQQQKQLEQIQQQVDCRELTDMTVSKFKKVISILNRTGHARFRRGPVAARSQSQSQGPASPEPAQSAPAPAARPLTLDFTKSVSGYSRDSWFSVSGAS

SEQ ID NO: 41105 - DNA, 707 bp, Zea mays
  misc_feature: Ceres CLONE 1435691-F
  misc_feature: Translation starting site: 203
ggcggccgctctagaactagtggatcccccgggctgcaggaattcgcacgagaccattacctagaacatcctaatcgaaaacgcgttccctggctccctgcgttgcgtcttgggggagagagagaagtgggagacccgcgagaggctgccgtgtagggactagggaccgtagagtaagcgacagcgaaggagggagagggggatggccgggatcgggccgatcagacaggactgggagccggtggttgtgcggaagaaggcacccaccgccgctgccaagaaggatgaaaaggccgtcaacgccgcgcgccgctccggcgcggaaatcgagaccatgaagaagtacaacgctggtatgaacaaggcggcgtccagcggcacatccctcaacaccaagcgcctcgacaataacacagagaacctcgcccatgagcgagttcccagtgacctgaagaaaaatctcatgcaagcaagggctcgatagaagttgacccaggcacagcttgctacaaatgatcatgagaagccacaggggatccaaggagtatgagtcaggccaggccttccccaaccaccaaattcttggcaactccaaaaggccctggaaaacaaacctccttggaaaaataaccccggacccccaagggaaaaaaggaaccggccccgctttattttccaggttggggcccccaagccggggaacttgt

SEQ ID NO: 41106 - DNA, 671 bp, Zea mays
  misc_feature: Ceres CLONE 1435700-F
  misc_feature: Encodes the peptide sequence at SEQ ID NO. 41107
  misc_feature (502)..(502): n is a, c, t, g, unknown, or other
  misc_feature (545)..(545): n is a, c, t, g, unknown, or other
  misc_feature (574)..(574): n is a, c, t, g, unknown, or other
agagctggagctccccgcggtggcggccgctctagaactagtggatcccccgggctgcaggaattcgcacgagaccattacctagaacatcctaatcgaaaagtacctgagaaatggcggccgtctcctccacctccaccgcctcctcctacttctcctcgcagccgcagctgccgatctccaccgccgaccctgccgccagcaaaagtaggttgatgcggcagccacggcggagcagcagcttcgtgatgatggaggcgtcctctgccagcggcagcgacggcggggtggccaggacgaagagcctcacggaggacgacctggaggagctcaagggctgcctcgacctcggcttcggattcgcgtacagcgagatacccgagctctgcgggacgctgcccgcgctcgaactctgctactccatgacccggaggttcctcgacgagcagaaggcgccggggcaggaggaggagttggagcctgcgtcgccgccgctcccaanttggaggatctctgggcccggtgacgatccaaaagaagtgaangcgaggttgaagtattgggctcaagctgntgcatgcactgtcaggctctgcagctaaactaaaggtcggaaaaaggctgaaaatcctgggtaattgtttttgaaatccgggacccgaaggggggcc

SEQ ID NO: 41107 - protein, 162 aa, Zea mays
  misc_feature: Ceres CLONE 1435700-F
  misc_feature (11)..(127): Pfam Name: DUF1685 Pfam Description: Protein of unknown function (DUF1685)
  misc_feature (130)..(130): Xaa is any aa, unknown, or other
  misc_feature (144)..(144): Xaa is any aa, unknown, or other
  misc_feature (154)..(154): Xaa is any aa, unknown, or other
MAAVSSTSTASSYFSSQPQLPISTADPAASKSRLMRQPRRSSSFVMMEASSASGSDGGVARTKSLTEDDLEELKGCLDLGFGFAYSEIPELCGTLPALELCYSMTRRFLDEQKAPGQEEELEPASPPLPXWRISGPGDDPKEVXARLKYWAQAXACTVRLCS

SEQ ID NO: 41108 - DNA, 757 bp, Zea mays
  misc_feature: Ceres CLONE 1435703-F
  misc_feature: Encodes the peptide sequence at SEQ ID NO. 41109
  misc_feature (36)..(36): n is a, c, t, g, unknown, or other
  misc_feature (38)..(38): n is a, c, t, g, unknown, or other
  misc_feature (45)..(45): n is a, c, t, g, unknown, or other
gattcccccctgttgtttaacagcaactccggctgngnataaaanaactcatagctgggactcaccgcggtggcggccgctctacaatagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccggccctatcacccgtgcagtgattggtacaaacaatcagggcacagcagctgcaccaactcgtgctacctgtgatcaaccaagtagctctggcaaacctttctacctactctcagcaacaacaatttcttccattaaagcaactgtctacactgaaccctgctgcttatttgcagcaataactattacgattcagtcagttaagctactgcctactcccagcaacaacaacttcttccctttaaccaagttggcaaccctgaaccccgctgcttatttgcggcgcgccaaacctactacccattg

SEQ ID NO: 41109 - protein, 84 aa, Zea mays
  misc_feature: Ceres CLONE 1435703-F
MATKIFSLLMLLALSACVANATIFPQCSQAPIASLLPPYLPSMIASVCENPALQPYRLQQAIAASNIPLSPLLFQQSPALSPVQ

SEQ ID NO: 41110 - DNA, 711 bp, Zea mays
  misc_feature: Ceres CLONE 1435706-F
  misc_feature: Encodes the peptide sequence at SEQ ID NO. 41111
aagctggagctccccgcggtggcggccgctctagaactagtggatcccccgggctgcaggaattcgcacgagaccattacctagaacatcctaatcgaaaaactcgctctctcccctctggctctgagtggcgctagtgggcgaccgccgccgcgtccctccgtcaggtgcccaggtgtagcctcgtcggcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttc

SEQ ID NO: 41111 - protein, 148 aa, Zea mays
  misc_feature: Ceres CLONE 1435706-F
  misc_feature (23)..(148): Pfam Name: G-alpha Pfam Description: G-protein alpha subunit
MSVLTCVIESMGSSCSRSHSFDEAEAAENAKSADIDRRILQETKAEQHIHKLLLLGAGESGKSTIFKQILYEGAKELAQVEPDSSKYVLSPDNQEIGEKLSEIGARLEYPSLNKERVQDVRKLWQDPAIQETYSRGSILQVPDCAQYF

SEQ ID NO: 41112 - DNA, 790 bp, Zea mays
  misc_feature: Ceres CLONE 1435708-F
  misc_feature: Encodes the peptide sequence at SEQ ID NO. 41113
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttgccccccccccnnnnnccnnatgtcccacctcnnnnncaannnnnttcaaagctggactccccgcggtggcggccgctctattctagtggatcccccgggctgcaggaattttcacgagaccattacctagaacatcctaatcgaaaaaaacaaacagggtagagggttaggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgcgcaatctgcaagtacgctgctcgccaaaacaagccagagctggtgaacccaaggaaacctcgaggagggcacaatgggtggatgtttggatcgagggggaggctaaccagtacaccgctgcactgaatcccatcctccttccagtcctcctcagtccgatgctggggggaacccaccgaccacaaaaggtgggggatgagaacccttgaaaagctggaggaagggggctaaaaggtggaacgagggcaccgcctggaaccaagggaaaggtaccctttgcttgggagaatttccctcaagccctcgcgccgaaacttggaaccgggggggtcctgggccccctctcgggggccggggtccccgctacg

SEQ ID NO: 41113 - protein, 110 aa, Zea mays
  misc_feature: Ceres CLONE 1435708-F
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MAPMKLYGAVMSWNVTRCATALEEAGSDYEIVPINFATAEHKSPEHLVRNPFGQVPALQDGDLYLFESRAICKYAARQNKPELVNPRKPRGGHNGWMFGSRGRLTSTPLH
